US012679870B2

(12) United States Patent
Kwong et al.

(10) Patent No.: US 12,679,870 B2
(45) Date of Patent: Jul. 14, 2026

(54) RECOMBINANT HUMAN METAPNEUMOVIRUS F PROTEINS AND THEIR USE

(71) Applicant: The United States of America, as represented by the Secretary, Department of Health and Human Services, Bethesda, MD (US)

(72) Inventors: Peter Kwong, Washington, DC (US); Guillaume Stewart-Jones, Cambridge, MA (US); Jason Gorman, New York, NY (US); Li Ou, Potomac, MD (US); Tongqing Zhou, Boyds, MD (US); Baoshan Zhang, Bethesda, MD (US); Wing-Pui Kong, Germantown, MD (US); Yaroslav Tsybovsky, Brunswick, MD (US); John Mascola, Rockville, MD (US); Peter Collins, Kensington, MD (US); Ursula Buchholz, Silver Spring, MD (US)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 872 days.

(21) Appl. No.: 17/919,733

(22) PCT Filed: Apr. 29, 2021

(86) PCT No.: PCT/US2021/029988
§ 371 (c)(1),
(2) Date: Oct. 18, 2022

(87) PCT Pub. No.: WO2021/222639
PCT Pub. Date: Nov. 4, 2021

(65) Prior Publication Data
US 2023/0174587 A1     Jun. 8, 2023

Related U.S. Application Data

(60) Provisional application No. 63/017,581, filed on Apr. 29, 2020.

(51) Int. Cl.
*C07K 14/005*     (2006.01)
*A61K 39/155*     (2006.01)
*A61P 31/14*     (2006.01)

(52) U.S. Cl.
CPC .......... *C07K 14/005* (2013.01); *A61K 39/155* (2013.01); *A61P 31/14* (2018.01); *C07K 2299/00* (2013.01); *C07K 2319/03* (2013.01); *C07K 2319/50* (2013.01); *C12N 2760/18322* (2013.01); *C12N 2760/18334* (2013.01); *C12N 2760/18371* (2013.01)

(58) Field of Classification Search
None
See application file for complete search history.

(56) References Cited

U.S. PATENT DOCUMENTS

| | | | |
|---|---|---|---|
| 10,420,834 | B2 | 9/2019 | Kwong et al. |
| 11,027,007 | B2 | 6/2021 | Kwong et al. |
| 2014/0072958 | A1 | 3/2014 | Nabel et al. |

FOREIGN PATENT DOCUMENTS

| | | |
|---|---|---|
| CN | 103842374 A | 6/2014 |
| WO | WO 2010/149743 A2 | 12/2010 |
| WO | WO 2012/158613 A1 | 11/2012 |
| WO | WO 2014/160463 A1 | 10/2014 |
| WO | WO 2016/103238 A1 | 6/2016 |

OTHER PUBLICATIONS

Battles et al. Nature Communications vol. 8, p. 1528 (Year: 2017).*
Bar-Peled et al., "A Potent Neutralizing Site III-Specific Human Antibody Neutralizes Human Metapneumovirus In Vivo," *J Virol.* 93.19: e00342-19, Oct. 2019 (15 pages).
Bastien et al., "Sequence analysis of the N, P, M and F genes of Canadian human metapneumovirus strains," *Virus Research* 93.1: 51-62, 2003.
Battles et al., "Structure and immunogenicity of pre-fusion-stabilized human metapneumovirus F glycoprotein," *Nat Comm.* 8: 1528, 2017 (11 pages).
Corti et al., "Cross-neutralization of four paramyxoviruses by a human monoclonal antibody," *Nature* 501: 439-443, Sep. 2013 (with supplementary information, 16 pages).
Crowe et al., "Satisfactorily attenuated and protective mutants derived from a partially attenuated cold-passaged respiratory syncytial virus mutant by introduction of additional attenuating mutations during chemical mutagenesis," *Vaccine* 12.6: 691-699, 1994.
Edwards et al., "Burden of human metapneumovirus infection in young children," *New England Journal of Medicine* 368.7: 633-643, 2013.
International Search Report and Written Opinion issued in International Patent Application No. PCT/US2021/029988 by the European Searching Authority, mailed on Dec. 8, 2021 (20 pages).
(Continued)

*Primary Examiner* — Shanon A. Foley
*Assistant Examiner* — Myron G Hill
(74) *Attorney, Agent, or Firm* — Klarquist Sparkman, LLP

(57)     ABSTRACT

Metapneumovirus (HMPV) F ectodomain trimers stabilized in a prefusion or postfusion conformation, nucleic acid molecules and vectors encoding these proteins, and methods of their use and production are disclosed. In several embodiments, the HMPV F ectodomain trimers and/or nucleic acid molecules can be used to generate an immune response to HMPV in a subject. In additional embodiments, the therapeutically effective amount of the HMPV F ectodomain trimers and/or nucleic acid molecules can be administered to a subject in a method of treating or preventing HMPV infection.

36 Claims, 38 Drawing Sheets
Specification includes a Sequence Listing.

(56) References Cited

OTHER PUBLICATIONS

International Search Report and Written Opinion issued in International Application No. PCT/IB2015/059991 by the European Searching Authority, mailed on Apr. 12, 2016, (11 pages).

Jain et al., "Community-Acquired Pneumonia Requiring Hospitalization among U.S. Children," *N Engl J Med.* 372.9: 835-845, Feb. 2015.

Jain et al., "Community-Acquired Pneumonia Requiring Hospitalization among U.S. Adults," *N Engl J Med.* 373.5: 415-427, Jul. 2015.

Joyce et al., "Iterative structure-based improvement of a respiratory syncytial virus fusion glycoprotein vaccine," *Nat Struct Mol Biol.* 23.9: 811-820, Sep. 2016.

Joyce et al., "Crystal Structure and Immunogenicity of the DS-CAV1-Stabilized Fusion Glycoprotein from Respiratory Syncytial Virus Subtype B," *Pathogens and Immunity* 4.2: 294-323, Dec. 2019.

Kapikian et al., "An Epidemiological Study of Altered Clinical Reactivity to Respiratory Syncytial (RS) Virus Infection in Children Previously Vaccinated with an Inactivated RS Virus Vaccine," *Am J Epidemiol.* 89.4: 405-421, 1989.

Karron et al., "Evaluation of Two Live, Cold-Passaged, Temperature-Sensitive Respiratory Syncytial Virus Vaccines in Chimpanzees and in Human Adults, Infants, and Children," *J Infect Dis.* 176: 1428-1436, 1997.

Krarup et al., "A highly stable prefusion RSV F vaccine derived from structural analysis of the fusion mechanism," *Nat Comm.* 6: 8143, 2015 (12 pages).

Lee et al., "Reversible inhibition of the fusion activity of measles virus F protein by an engineered intersubunit disulfide bridge," *Journal of Virology* 81.16: 8821-8826, 2007.

Liang et al., "Enhanced Neutralizing Antibody Response Induced by Respiratory Syncytial Virus Prefusion F Protein Expressed by a Vaccine Candidate," *J Virol.* 89.18: 9499-9510, Sep. 2015.

Liu et al., "A Live Attenuated Human Metapneumovirus Vaccine Strain Provides Complete Protection against Homologous Viral Infection and Cross-Protection against Heterologous Viral Infection in BALB/c Mice," *Clin and Vaccine Immunol.* 20.8: 1246-1254, Aug. 2013.

McLellan et al., "Structure of RSV Fusion Glycoprotein Trimer Bound to a Prefusion-Specific Neutralizing Antibody," *Science* 340.6136: 1113-1117, May 2013.

McLellan et al., "Structure-Based Design of a Fusion Glycoprotein Vaccine for Respiratory Syncytial Virus," *Science* 342.6158: 592-598, Nov. 2013.

Ngwuta et al., "Prefusion F-specific antibodies determine the magnitude of RSV neutralizing activity in human sera," *Sci Transl Med.* 7.309: 309ra16, Oct. 2015 (19 pages).

Panda et al., "Human metapneumovirus: review of an important respiratory pathogen," *Internatl J Infect Dis.* 25: 45-52, 2014.

Poor et al., "On the Stability of Parinfluenza Virus 5 Proteins," *J Virol.* 89.6: 3438-3441, Mar. 2015.

Russell et al., "Vaccines for the Paramyxoviruses and Pneumoviruses: Successes, Candidates, and Hurdles," *Viral Immunol.* 31.2: 133-141, 2018.

Stewart-Jones et al., "A Cysteine Zipper Stabilizes a Pre-Fusion F Glycoprotein Vaccine for Respiratory Syncytial Virus," *PLoS One* 10.6: e0128779, Jun. 2015 (16 pages).

Stewart-Jones et al., "Structure-based design of a quadrivalent fusion glycoprotein vaccine for human parainfluenza virus types 1-4," *Proc Natl Acad Sci USA* 115.48: 12265-12270, Nov. 2018.

Welch et al., "Structure of the cleavage-activated prefusion form of the parainfluenza virus 5 fusion protein," *Proc Natl Acad Sci USA* 109.41: 16672-16677, Oct. 2012.

Wen et al., "Structure of the Human Metapneumovirus Fusion Protein with Neutralizing Antibody Identifies a Pneumovirus Antigenic Site," *Nat Struct Mol Biol.* 19.4: 461-463, 2016.

* cited by examiner

FIG. 1B v1-B: HMPV(B) F: A113C-A339C
v2-B: HMPV(B) F: A113C-A339C A120C-Q426C
v3-B: HMPV(B) F: A140C-A147C V84C-A249C

MPE33 Fab

Ordered "head" region

Partially disordered "stem" region

HMPV F v3-B trimer from strain CAN98-75
Interprotomer V84C-A249C
Intraprotomer A140C-A147C Prefusion to postfusion distance ▮ >5Å
Prefusion to postfusion distance ▓ <5Å

FIG. 1D

Density for prefusion residues 113-179

140

147

240

Trimer
(transparent surface density)

Protomer
(mesh density)

HMPV F v4-B from strain CAN98-75
Interprotomer 182C-K188C
Intraprotomer 60C-A63C
Postfusion to prefusion distance ▮ >5Å
Postfusion to prefusion distance ▮ <5Å

Healthy adult human sera

● HMPV A2 (CAN97-83)
○ HMPV B2 (CAN98-75)

Cohort of heathy adult human sera
assessed on CAN97-83 (left) and
CAN98-75 (right)

FIG. 7A

Intraprotomer and interprotomer disulfides used for stabilizing HMPV F

| HMPV variants | State | Intraprotomer | | | Interprotomer | | | Other mutations |
|---|---|---|---|---|---|---|---|---|
| | | 60C-A63C | A113C-A339C | A140C-A147C | V84C-A249C | A120C-Q426C | 182C-K188C | |
| v1 | PreF-like | | x | | | | | T160F, I170L |
| v2 | PreF-like | | x | | | x | | T160F, I170L |
| v3 | PreF-like | | | x | x | | | |
| v4* | PostF-like | x | | | | | x | A140C, A147C, K450C, S470C |
| v5 | PostF-like | x | | | | | x | A140C, A147C |
| post | Postfusion | | | | | | | N-terminal 4 residues of FP removed |

*Original design of v4 involved A140C-A147C, A63C-K188C, and K450C-S470C; cryo-EM defined model delineated 60C-A63C and 182C-K188C (with A140C; A147C; K50C; S470C).

FIG. 7B

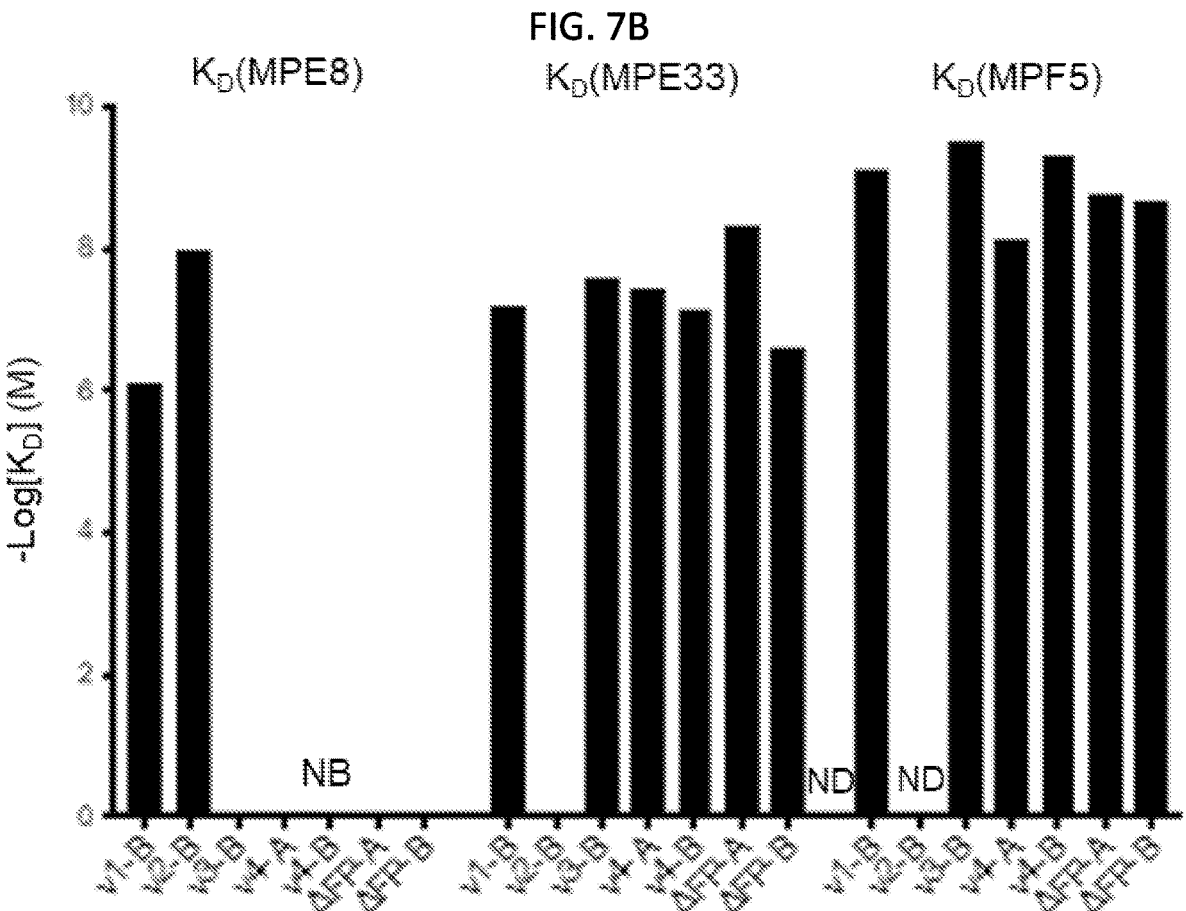

$K_D$(MPE8)          $K_D$(MPE33)          $K_D$(MPF5)

$-\text{Log}[K_D]$ (M)

FIG. 7C

```
                                                                                                    19
v1-B  MATMSWKVMIIISLLITPQHGLKESYLEESCSTITEGYLSVLRTGWYTNVFTLEVGDVENLTCTDGPSLIKTELDLTKSALRELKTVSADQLAREEQIENPRKARFVLGAIALGVCTAAAVTAGIAIAKT  130
v2-B  MATMSWKVMIIISLLITPQHGLKESYLEESCSTITEGYLSVLRTGWYTNVFTLEVGDVENLTCTDGPSLIKTELDLTKSALRELKTVSADQLAREEQIENPRKARFVLGAIALGVCTAAAVTCGIAIAKT  130
v3-B  ---MSWKVMIIISLLITPQHGLKESYLEESCSTITEGYLSVLRTGWYTNVFTLEVGDVENLTCTDGPSLIKTELDLTKSALRELKTCSADQLAREEQIENPRKARFVLGAIAIGVATAAAVTAGIAIAKT  127
v4-A  ---MSWKVVIIFSLLITPQHGLKESYLEESCSTITEGYLSVLRTGWYTNVFTLEVGDVENLTCSDCPSLIKTELDLTKSALRELKTCSDCPSLIKTELDLTKSALRELKTVSADQLAREEQIEGGGGGFVL-AIALGVATAAAVTAGIATAKT  126
v4-B  ---MSWKVVIIFSLLITPQHGLKESYLEESCSTITEGYLSVLRTGWYTNVFTLEVGDVENLTCTDCPSLIKTELDLTKSALRELKTCSDQLAREEQIEGGGGGFVL-AIALGVATAAAVTAGIAIAKT  127
v5-A  ---MSWKVVIFSLLITPQHGLKESYLEESCSTITEGYLSVLRTGWYTNVFTLEVGDVENLTCTDCPSLIKTELDLTKSALRELKTCSDQLAREEQIEGGGGGFVL-AIALGVATAAAVTAGVAIAKT  126
post-A ---MSWKVVIFSLLITPQHGLKESYLEESCSTITEGYLSVLRTGWYTNVFTLEVGDVENLTCSDGPSLIKTELDLTKSALRELKTVSADQLAREEQIENRRRRR-----AIALGVATAAAVTAGVAIAKT  123
post-B ---MSWKVMIIISLLITPQHGLKESYLEESCSTITEGYLSVLRTGWYTNVFTLEVGDVENLTCTDGPSLIKTELDLTKSALRELKTVSADQLAREEQIENRRRRR-----AIALGVATAAAVTAGIAIAKT  123 v1-B  IRLESEVNAIKGALKTTNEAVSTLGNGVRVLAFAVRELKEFVSKNLTSAINKNKCDIADLKMAVSFSQFNRRFLNVVRQFSDNAGITPAISLDLMTDAELARAVSYMPTSAGQIKLMLENRAMVRRKGFG  260
v2-B  IRLESEVNAIKGALKTTNEAVSTLGNGVRVLAFAVRELKEFVSKNLTSAINKNKCDIADLKMAVSFSQFNRRFLNVVRQFSDNAGITPAISLDLMTDAELARAVSYMPTSAGQIKLMLENRAMVRRKGFG  260
v3-B  IRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFG  257
v4-A  IRLESEVTAIKNCLKTTNECVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFG  256
v4-B  IRLESEVNAIKGCLKTTNECVSTLGNGVRVLATAVRELKEFVSKNLTSAINKNKCDIDDLCMAVSFSQFNRRFLNVVRQFSDNAGITPAISLDLMTDAELARAVSYMPTSAGQIKLMLENRAMVRRKGFG  257
v5-A  IRLESEVTAIKNCLKTTNECVSTLGNGVRVLATAVRELKDFVSKNLTSAINKNKCDIDDLCMAVSFSQFNRRFLNVVRQFSDNAGITPAISLDLMTDAELARAVSNMPTSAGQIKLMLENRAMVRRKGFG  256
post-A IRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFG  253
Post-B IRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFG  253
```

FIG. 7D

```
v1-B    ILIGVYGSSVIYMVQLPIFGVIDTPCWIIKAAPSCSEKDGNYACLLREDQGWYCKNAGSTVYYPNDKDCETRGDHVFCDTAⓍGINVAEQSRECNINISTTNYPCKVSTGRHPISMVALSPLGALVACYKG  390
v2-B    ILIGVYGSSVIYMVQLPIFGVIDTPCWIIKAAPSCSEKDGNYACLLREDQGWYCKNAGSTVYYPNDKDCETRGDHVFCDTAⓍGINVAEQSRECNINISTTNYPCKVSTGRHPISMVALSPLGALVACYKG  390
v3-B    ILIGVYGSSVIYMVQLPIFGVIDTPCWIIKAAPSCSEKDGNYACLLREDQGWYCKNAGSTVYYPNDKDCETRGDHVFCDTAⓍGINVAEQSRECNINISTTNYPCKVSTGRHPISMVALSPLGALVACYKG  387
v4-A    ILIGVYGSSVIYMVQLPIFGVIDTPCWIVKAAPSCSGKKGNYACLLREDQGWYCQNAGSTVYYFNEKDCETRGDHVFCDTAAGINVAEQSKECNINISTTNYPCKVSTGRHPISMVALSPLGALVACYKG  386
v4-B    ILIGVYGSSVIYMVQLPIFGVIDTPCWIVKAAPSCSGKKGNYACLLREDQGWYCQNAGSTVYYFNFDKDCETRGDHVFCDTAAGINVAEQSKECNINISTTNYPCKVSTGRHPISMVALSPLGALVACYKG  387
v5-A    ILIGVYGSSVIYMVQLPIFGVIDTPCWIVKAAPSCSGKKGNYACLLREDQGWYCQNAGSTVYYFPNEKDCETRGDHVFCDTAAGINVAEQSKECNINISTTNYPCKVSTGRHPISMVALSPLGALVACYKG  386
post-A  ILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKG  383
post-B  ILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKG  383

485
v1-B    VSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTFLG  520
v2-B    VSCSIGSNRVGIIKQLPKGCSYITNQDADTVTIDNTVYⓒLSKVEGEQHVIKGRPVSSSFDPIKFPEDQFNVALDQVFESIENSQALVDQSNKILNSAESAIGGYIPEAPRDGQAYVRKDGEWVLLSTFLG  520
v3-B    VSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTFLG  517
v4-A    VSCSIGSNRVGIIKQLNKGCSYITNQDADTVTIDNTVYQLSKVEGEQHVIKGRPVSSSFDPICFPEDQFNVALDQVFENIENⓒQALVDQSNRILSSAESAIGGYIPEAPRDGQAYVRKDGEWVLLSTFLG  516
v4-B    VSCSIGSNRVGIIKQLPKGCSYITNQDADTVTIDNTVYQLSKVEGEQHVIKGRPVSSSFDPICFPEDQFNVALDQVFENIENSQALVDQSNRILSSAESAIGGYIPEAPRDGQAYVRKDGEWVLLSTFLG  517
v5-A    VSCSIGSNRVGIIKQLNKGCSYITNQDADTVTIDNTVYQLSKVEGEQHVIKGRPVSSSFDPIKFPEDQFNVALDQVFENIENSQALVDQSNRILSSAESAIGGYIPEAPRDGQAYVRKDGEWVLLSTFLG  516
post-A  VSCSIGSNRVGIIKQLPKGCSYITNQDADTVTIDNTVYQLSKVEGEQHVIKGRPVSSSFDPIKFPEDQFNVALDQVFESIENSQALVDQSNRILSSASEAI------------------------------  G  485
post-B  VSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAI-----------------------------  G  485 v1-B    GLVPRGSHHHHHHSAWSHPQFEK  543
v2-B    GLVPRGSHHHHHHSAWSHPQFEK  543
v3-B    GLVPRGSHHHHHHSAWSHPQFEK  540
v4-A    GLVPRGSHHHHHHSAWSHPQFEK  539
v4-B    GLVPRGSHHHHHHSAWSHPQFEK  540
v5-A    GLVPRGSHHHHHHSAWSHPQFEK  539
post-A  GLVPRGSHHHHHHSAWSHPQFEK  508
post-B  GLVPRGSHHHHHHSAWSHPQFEK  508
```

HMPV F, v1-B

HMPV F, v2-B

HMPV F, v3-B

FIG. 11

Cryo-EM Data Collection and Refinement Statistics

| | HMPV F v4-B | HMPV F v3-B in complex with MPE33 |
|---|---|---|
| EMDB ID | xxxx | xxxx |
| PDB ID | xxxx | * |
| Data Collection | | |
| Microscope | FEI Titan Krios | FEI Titan Krios |
| Voltage (kV) | 300 | 300 |
| Electron dose ($e^-/Å^2$) | 64.05 | 63.78 |
| Detector | Gatan K2 Summit | Gatan K2 Summit |
| Pixel Size (Å) | 1.096 | 1.096 |
| Defocus Range (μm) | -0.07, -3.13 | -0.01, -3.18 |
| Magnification | 105000 | 105000 |
| | | |
| Reconstruction | | |
| Software | cryoSparcV2.14 | cryoSparcV2.14 |
| Particles | 75018 | 56220 |
| Symmetry | C3 | C3 |
| Box size (pix) | 264 | 400 |
| Resolution (Å) ($FSC_{0.143}$) | 3.25 | 4.13 |
| | | |
| Refinement | | |
| Software | Phenix 1.17 | |
| Protein residues | 1011 | |
| Chimera CC | 0.85 | |
| EMRinger Score | 2.41 | |
| | | |
| R.m.s. deviations | | |
| Bond lengths (Å) | 0.006 | |
| Bond angles (°) | 0.83 | |
| | | |
| Validation | | |
| Molprobity score | 1.65 | |
| Clash score | 3.19 | |
| Rotamer Outliers(%) | 0.34 | |
| Ramachandran | | |
| Favored regions (%) | 93.4 | |
| Disallowed regions (%) | 0.11 | |

\* Membrane-proximal region of HMPV F v3 complex with MPE33 was too flexible for model fitting.

FIG. 12

```
WT             LDLTKSALRELRTVSADQLAREEQIENPR    QSRFVLGAIALGVATAAA         SEQ ID NO: 211
HMPV_v3B       LDLTKSALRELKTcSADQLAREEQIEGGG----GGGFVLGAIALGVATAAA         SEQ ID NO: 212
HMPV_v3B_L1.2  LDLTKSALRELKTcSADQLAREEQIEGGGGsgGGGGFVLGAIALGVATAAA +3      SEQ ID NO: 213
HMPV_v3B_L1.0  LDLTKSALRELKTcSADQLAREEQIE------GGGFVLGAIALGVATAAA -3       SEQ ID NO: 214
HMPV_v3B_L1.1  LDLTKSALRELKTcMQSTPAT----------GSGS----------A---- -21     SEQ ID NO: 215
HMPV_v3B_L0.0  LDLTKSALRELKTcSADQ--------------gsg--------ATAAA -15       SEQ ID NO: 216
HMPV_v3B_L0.1  LDLTKSALRELKTcSADQ----------gsggsg--------ATAAA -12       SEQ ID NO: 217
HMPV_v3B_L0.2  LDLTKSALRELKTcSADQ------gsggsggsg--------ATAAA -9        SEQ ID NO: 218
HMPV_v3B_L4    LDLTKSALRELKTcMQSTPATNN------GSGS----------AI---- -18     SEQ ID NO: 219
HMPV_v3B_L3c   LDLTKSALRELKTcSADQLAREEQLEVL-FQGPggFVLGAIALGVATAAA +2      SEQ ID NO: 220
HMPV_v3B_L4c   LDLTKSALRELKTcMQLEVL-------------------------FQGPg -22     SEQ ID NO: 221
```

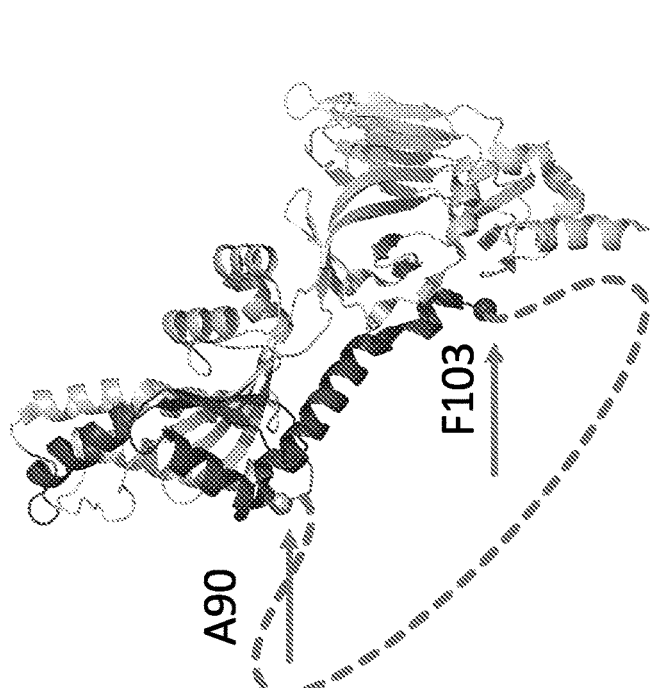

Linker of v3B: GGGGGG (SEQ ID NO: 147)

FIG. 13
HMPV v3B L0.1
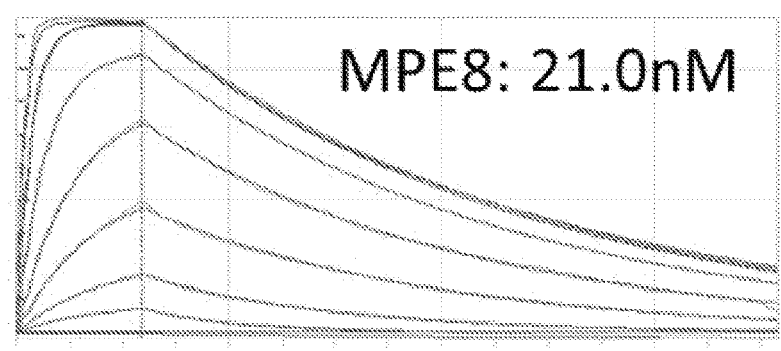
MPE8: 21.0nM
HMPV v3B L0.1 (Δ12)
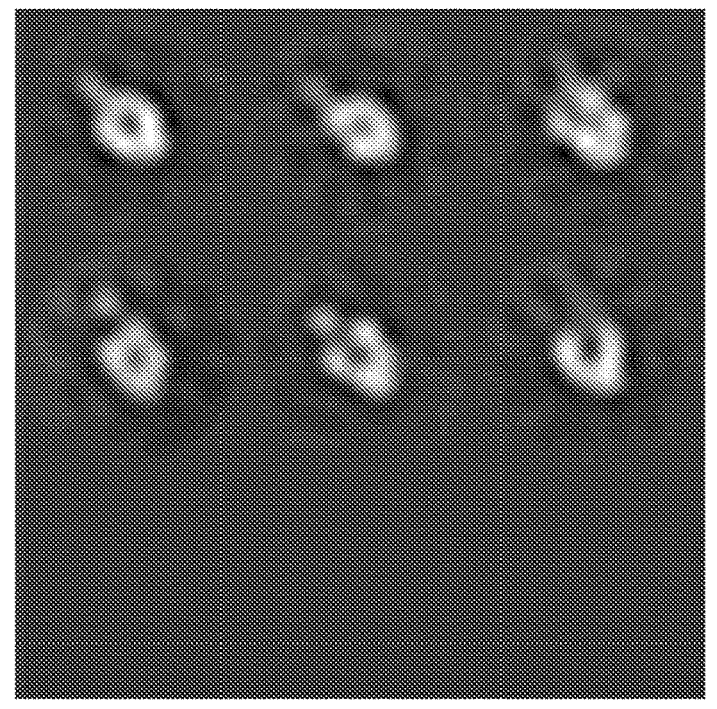

FIG. 14

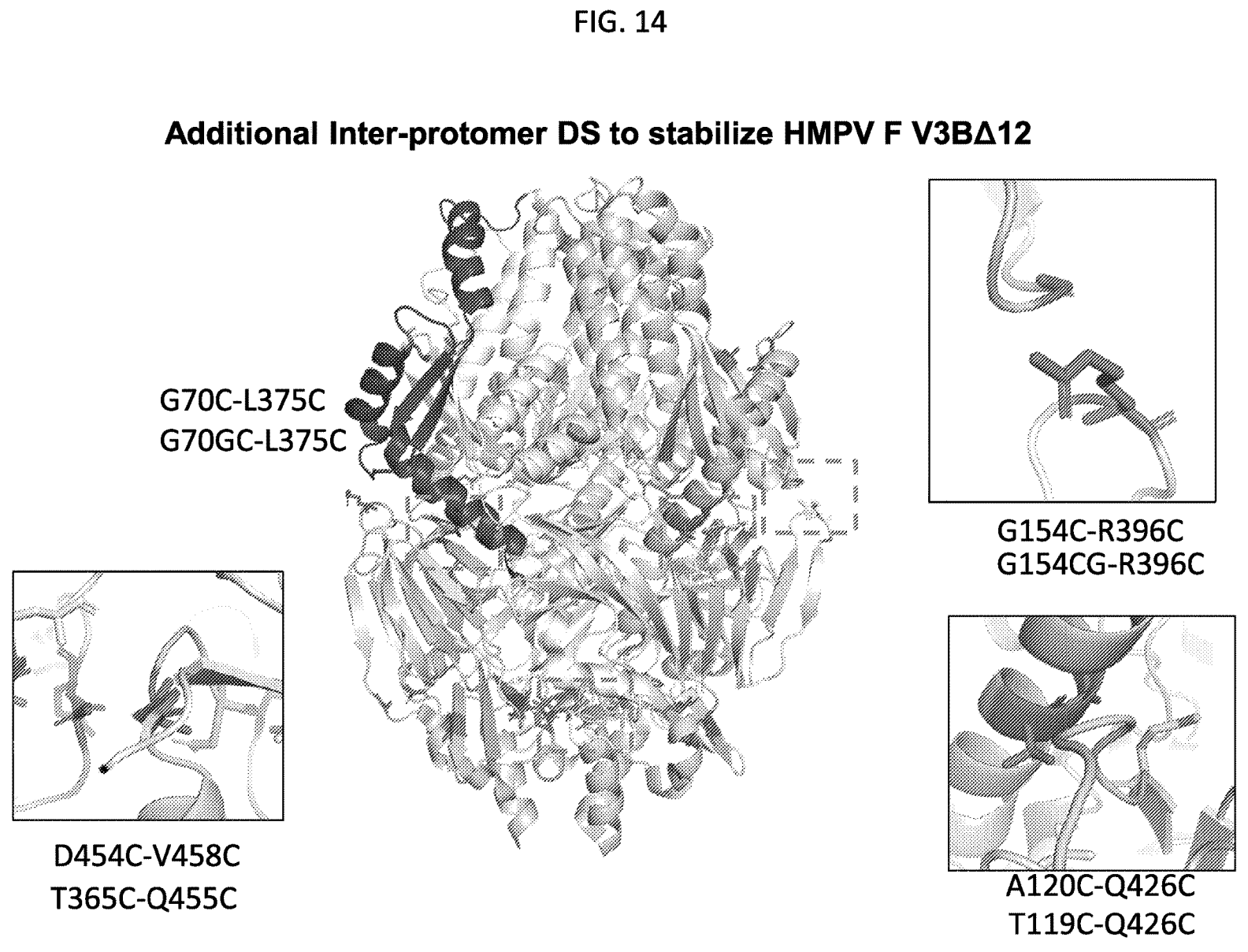

Additional Inter-protomer DS to stabilize HMPV F V3BΔ12

G154C-R396C
G154CG-R396C

A120C-Q426C
T119C-Q426C

G70C-L375C
G70GC-L375C

D454C-V458C
T365C-Q455C

FIG. 15A
HMPV F V3BΔ12 D454C/V458C
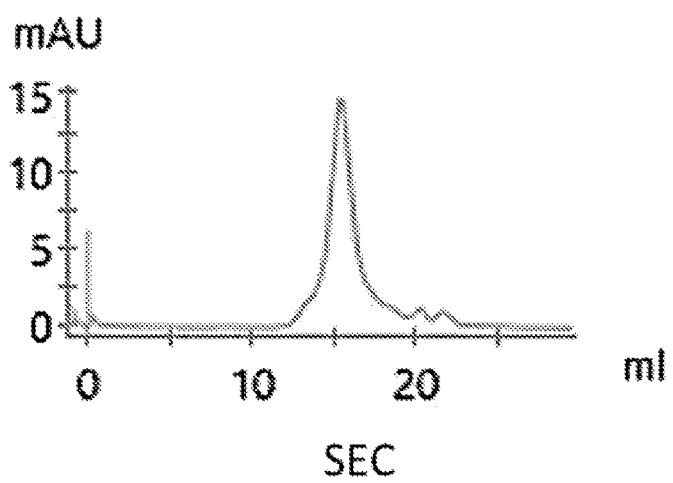
SEC
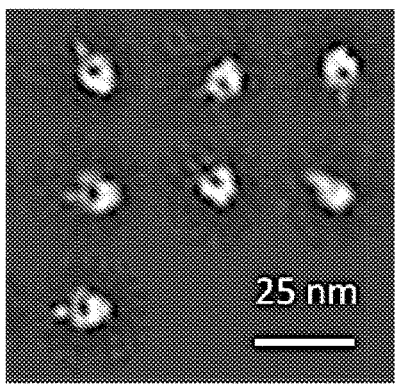
DTT + -
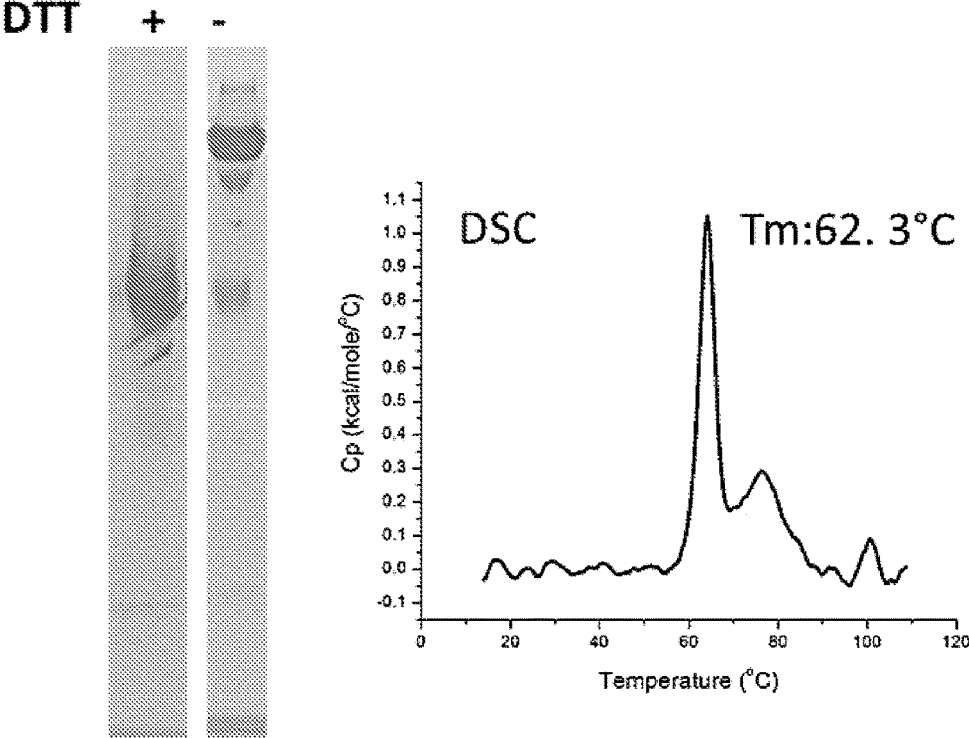

FIG. 15B
HMPV F V3BΔ12 T365C/Q455C
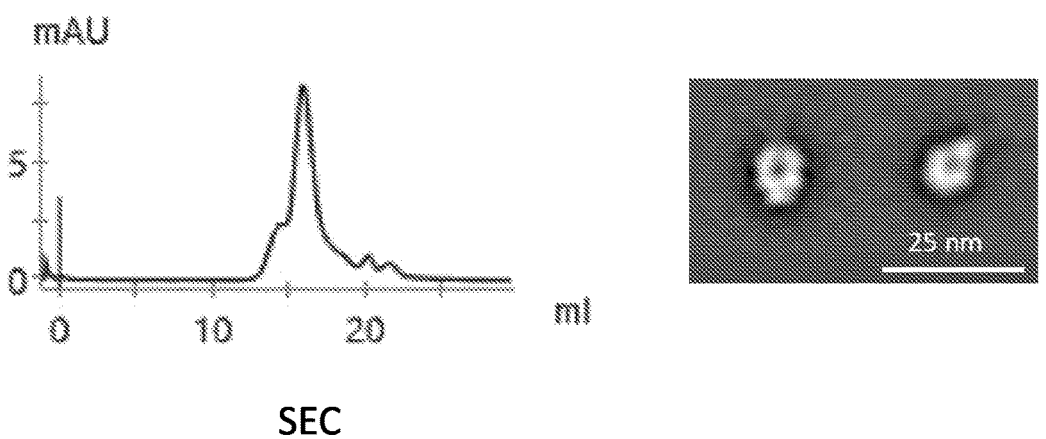
SEC
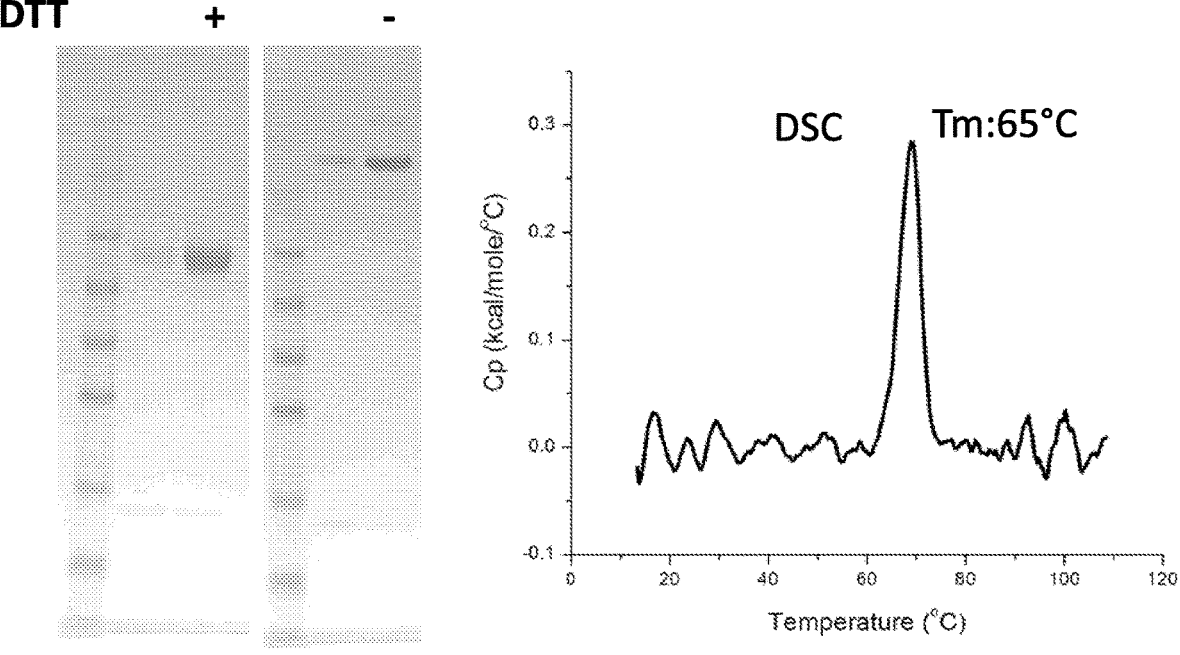

FIG. 16

MPE8 binding

| Sample | $K_D$ (nM) | $k_{on}$ ($M^{-1}s^{-1}$) | $k_{off}$ ($s^{-1}$) |
|---|---|---|---|
| HMPV v3B | N.B. | | |
| HMPV v3BΔ12 | $21.0 \pm 0.5$ | $(1.41 \pm 0.03) \times 10^5$ | $(2.96 \pm 0.02) \times 10^{-3}$ |
| HMPV v3BΔ12 D454/V458C | $8.1 \pm 0.1$ | $(2.25 \pm 0.03) \times 10^5$ | $(1.82 \pm 0.01) \times 10^{-3}$ |
| HMPV v3BΔ12 T365/Q455C | $25.3 \pm 0.3$ | $(1.63 \pm 0.02) \times 10^5$ | $(4.13 \pm 0.01) \times 10^{-3}$ |
| HMPV v3B D454C/V458C | N.B. | | |
| HMPV v3B T365C/Q455C | N.B. | | |

FIG. 17

MPF5 binding

| Sample | $K_D$ (nM) | $k_{on}$ (M$^{-1}$s$^{-1}$) | $k_{off}$ (s$^{-1}$) |
|---|---|---|---|
| HMPV v3B | $0.32 \pm 0.01$ | $(8.64 \pm 0.08) \times 10^5$ | $(2.77 \pm 0.08) \times 10^{-4}$ |
| HMPV v3BΔ12 | $0.78 \pm 0.01$ | $(3.28 \pm 0.02) \times 10^5$ | $(2.54 \pm 0.03) \times 10^{-4}$ |
| HMPV v3BΔ12 D454C/V458C | $0.71 \pm 0.01$ | $(1.71 \pm 0.01) \times 10^5$ | $(4.22 \pm 0.08) \times 10^{-4}$ |
| HMPV v3BΔ12 T365C/Q455C | $0.76 \pm 0.07$ | $(3.67 \pm 0.01) \times 10^5$ | $(2.78 \pm 0.08) \times 10^{-4}$ |
| HMPV v3B D454C/V458C | $0.57 \pm 0.01$ | $(3.7 \pm 0.5) \times 10^5$ | $(2.1 \pm 0.3) \times 10^{-4}$ |
| HMPV v3B T365C/Q455C | $0.60 \pm 0.01$ | $(3.8 \pm 0.5) \times 10^5$ | $(2.61 \pm 0.3) \times 10^{-4}$ |

MPE33 binding

| Sample | $K_D$ (nM) | $k_{on}$ (M$^{-1}$s$^{-1}$) | $k_{off}$ (s$^{-1}$) |
|---|---|---|---|
| HMPV v3B | $49.5 \pm 0.10$ | $(2.01 \pm 0.04) \times 10^4$ | $(9.95 \pm 0.07) \times 10^{-4}$ |
| HMPV v3BΔ12 | $2.69 \pm 0.04$ | $(1.95 \pm 0.02) \times 10^5$ | $(5.25 \pm 0.05) \times 10^{-4}$ |
| HMPV v3BΔ12 D454C/V458C | $3.37 \pm 0.01$ | $(2.12 \pm 0.01) \times 10^5$ | $(7.14 \pm 0.01) \times 10^{-4}$ |
| HMPV v3BΔ12 T365C/Q455C | $2.86 \pm 0.01$ | $(2.53 \pm 0.01) \times 10^5$ | $(7.25 \pm 0.01) \times 10^{-4}$ |
| HMPV v3B D454C/V458C | $9.0 \pm 0.3$ | $(1.53 \pm 0.04) \times 10^5$ | $(1.38 \pm 0.01) \times 10^{-3}$ |
| HMPV v3B T365C/Q455C | $3.1 \pm 0.3$ | $(2.5 \pm 0.04) \times 10^5$ | $(0.81 \pm 0.01) \times 10^{-3}$ |

Proline mutations to stabilize HMPV F V3BΔ12

PostF

PreF

FIG. 19
HMPV_v3BΔ12_E131P
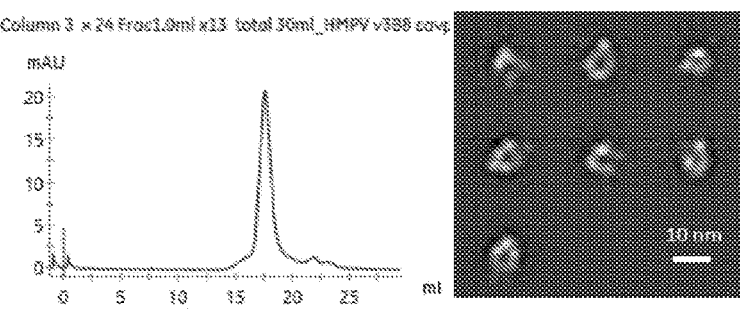
HMPV_v3BΔ12_N145P
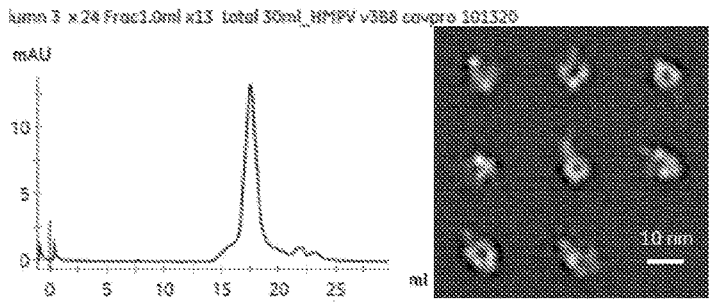
HMPV_v3BΔ12_R163P
HMPV_v3BΔ12_A459P
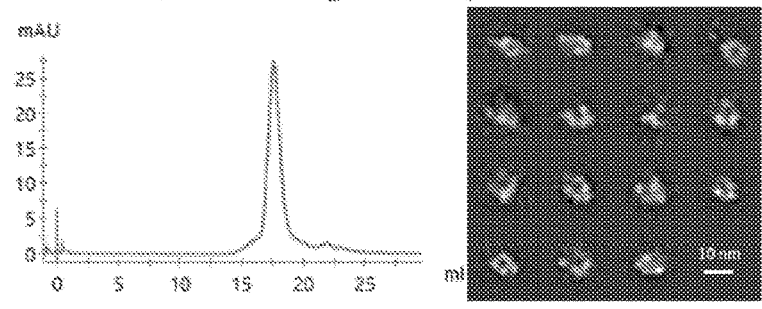

| Lane | Construct | Total Yield (mg/100mL) | IPDS | Binding to MPE8 Fab |
|------|-----------|------------------------|------|---------------------|
| 1 | HMPV_v3BΔ12_K143P | 0.36mg | Yes | Yes |
| 2 | HMPV_v3BΔ12_E131P | 1mg | Yes | Yes |
| 3 | HMPV_v3BΔ12_N145P | 1mg | Yes | Yes |
| 4 | HMPV_v3BΔ12_R163P | 1.8mg | Yes | Yes |
| 5 | HMPV_v3BΔ12_E131P-R163P | 1.8mg | Yes | Yes |
| 6 | HMPV_v3BΔ12_A459P | 1mg | Yes | Yes |

FIG. 21

| HMPV Construct | Yield (mg/100mL) |
|---|---|
| HMPV_v3BΔ12_E131P-K143P-N145P-R163P-A459P | 0.08 |
| HMPV_v3BΔ12_K143P-N145P-R163P-A459P | 0.14 |
| HMPV_v3BΔ12_K143P-N145P-R163P | 0.12 |
| HMPV_v3BΔ12_K143P-R163P-E131P | 0.25 |
| HMPV_v3BΔ12_K143P-R163P-A459P | 0.42 |
| HMPV_v3BΔ12_K143P-R163P-N145P | 0.09 |
| HMPV_v3BΔ12_E131P-K143P-N145P-R163P | 0.05 |
| HMPV_v3BΔ12_E131P-K143P-R163P-A459P | 0.38 |
| HMPV_v3BΔ12_E131P-N145P-R163P-A459P | 0.89 |
| HMPV_v3BΔ12_E131P-R163P-A459P | 2.43 |
| HMPV_v3BΔ12_E131P-R163P-N145P | 0.96 |

FIG. 22

MPE8 binding

| Sample | $K_D$ (nM) | $k_{on}$ (M$^{-1}$s$^{-1}$) | $k_{off}$ (s$^{-1}$) |
|---|---|---|---|
| HMPV_v3BD12 | $21.0 \pm 0.5$ | $(1.41 \pm 0.03) \times 10^5$ | $(2.96 \pm 0.02) \times 10^{-3}$ |
| HMPV_v3BD12_K143P | $5.16 \pm 0.08$ | $(4.67 \pm 0.07) \times 10^5$ | $(2.41 \pm 0.01) \times 10^{-3}$ |
| HMPV_v3BD12_E131P | $5.56 \pm 0.06$ | $(4.65 \pm 0.04) \times 10^5$ | $(2.58 \pm 0.01) \times 10^{-3}$ |
| HMPV_v3BD12_N145P | $5.96 \pm 0.06$ | $(3.86 \pm 0.04) \times 10^5$ | $(2.30 \pm 0.01) \times 10^{-3}$ |
| HMPV_v3BD12_R163P | $6.92 \pm 0.13$ | $(3.67 \pm 0.06) \times 10^5$ | $(2.54 \pm 0.01) \times 10^{-3}$ |
| HMPV_v3BD12_E131P-R163P | $6.85 \pm 0.09$ | $(3.68 \pm 0.05) \times 10^5$ | $(2.52 \pm 0.01) \times 10^{-3}$ |
| HMPV_v3BD12_A459P | $7.41 \pm 0.12$ | $(3.61 \pm 0.06) \times 10^5$ | $(2.67 \pm 0.01) \times 10^{-3}$ |
| HMPV_v3BD12_E131P-R163P-A459 | $6.95 \pm 0.10$ | $(3.05 \pm 0.01) \times 10^5$ | $(2.12 \pm 0.01) \times 10^{-3}$ |

FIG. 23

MPF5 binding

| Sample | $K_D$ (nM) | $k_{on}$ (M$^{-1}$s$^{-1}$) | $k_{off}$ (s$^{-1}$) |
|---|---|---|---|
| HMPV_v3BΔ12_K143P | 1.08 ± 0.02 | (10.2 ± 0.01) x 10$^5$ | (4.22 ± 0.08) x 10$^{-4}$ |
| HMPV_v3BΔ12_E131P | 0.35 ± 0.01 | (10.1 ± 0.12) x 10$^5$ | (3.53 ± 0.05) x 10$^{-4}$ |
| HMPV_v3BΔ12_N145P | 0.50 ± 0.02 | (7.88 ± 0.02) x 10$^5$ | (3.90 ± 0.12) x 10$^{-4}$ |
| HMPV_v3BΔ12_R163P | 0.76 ± 0.01 | (7.92 ± 0.01) x 10$^5$ | (6.01± 0.05) x 10$^{-4}$ |
| HMPV_v3BΔ12_E131P-R163P | 0.54 ± 0.01 | (8.04± 0.6) x 10$^5$ | (4.33 ± 0.4) x 10$^{-4}$ |
| HMPV_v3BΔ12_A459P | 0.20 ± 0.01 | (8.98 ± 0.07) x 10$^5$ | (1.83 ± 0.3) x 10$^{-4}$ |
| HMPV_v3BΔ12_E131P-R163P-A459 | 0.77 ± 0.01 | (5.76± 0.6) x 10$^5$ | (4.48 ± 0.4) x 10$^{-4}$ |

MPE33 binding

| Sample | $K_D$ (nM) | $k_{on}$ (M$^{-1}$s$^{-1}$) | $k_{off}$ (s$^{-1}$) |
|---|---|---|---|
| HMPV_v3BΔ12_K143P | 1.56 ± 0.04 | (8.88 ± 0.21) x 10$^5$ | (13.9 ± 0.01) x 10$^{-4}$ |
| HMPV_v3BΔ12_E131P | 1.70 ± 0.03 | (5.55 ± 0.08) x 10$^5$ | (9.45 ± 0.07) x 10$^{-4}$ |
| HMPV_v3BΔ12_N145P | 1.48 ± 0.02 | (5.06 ± 0.05) x 10$^5$ | (7.50 ± 0.05) x 10$^{-4}$ |
| HMPV_v3BΔ12_R163P | 1.65 ± 0.03 | (5.50 ± 0.08) x 10$^5$ | (9.05 ± 0.07) x 10$^{-4}$ |
| HMPV_v3BΔ12_E131P-R163P | 1.82 ± 0.03 | (4.81 ± 0.07) x 10$^5$ | (8.73 ± 0.07) x 10$^{-4}$ |
| HMPV_v3BΔ12_A459P | 1.34 ± 0.02 | (5.82 ± 0.06) x 10$^5$ | (7.82 ± 0.05) x 10$^{-4}$ |
| HMPV_v3BΔ12_E131P-R163P-A459 | 2.75 ± 0.03 | (3.47 ± 0.07) x 10$^5$ | (9.55 ± 0.07) x 10$^{-4}$ |

FIG. 24

MPE8 binding

| Sample ID3 | $K_D$ (nM) | $k_{on}$ ($M^{-1}s^{-1}$) | $k_{off}$ ($s^{-1}$) |
|---|---|---|---|
| HMPV v3BΔ12 | $21.0 \pm 0.5$ | $(1.41 \pm 0.03) \times 10^5$ | $(2.96 \pm 0.02) \times 10^{-3}$ |
| HMPV v3BΔ12 E131P-R163P | $6.95 \pm 0.10$ | $(3.05 \pm 0.01) \times 10^5$ | $(2.12 \pm 0.01) \times 10^{-3}$ |
| HMPV v3BΔ12 E131P-R163P-A459P | $6.85 \pm 0.09$ | $(3.68 \pm 0.05) \times 10^5$ | $(2.52 \pm 0.01) \times 10^{-3}$ |
| HMPV v3BΔ12 D454C/V458C | $8.1 \pm 0.1$ | $(2.25 \pm 0.03) \times 10^5$ | $(1.82 \pm 0.01) \times 10^{-3}$ |
| HMPV v3BΔ12 T365C/Q455C | $25.3 \pm 0.3$ | $(1.63 \pm 0.02) \times 10^5$ | $(4.13 \pm 0.01) \times 10^{-3}$ |
| HMPV v3BΔ12 D454/V458C, E131P-R163P | $6.95 \pm 0.1$ | $(3.05 \pm 0.03) \times 10^5$ | $(2.12 \pm 0.01) \times 10^{-3}$ |
| HMPV v3BΔ12 D454C/V458C, E131P-R163P-A459 | $13.1 \pm 0.2$ | $(9.9 \pm 0.1) \times 10^4$ | $(1.30 \pm 0.01) \times 10^{-3}$ |
| HMPV v3BΔ12 T365C/Q455C, E131P-R163P | $19.1 \pm 0.1$ | $(2.15 \pm 0.03) \times 10^5$ | $(4.09 \pm 0.01) \times 10^{-3}$ |
| HMPV v3BΔ12 T365C/Q455C, E131P-R163P-A459P | $45.8 \pm 0.6$ | $(9.9 \pm 0.1) \times 10^4$ | $(4.51 \pm 0.02) \times 10^{-3}$ |

FIG. 25A
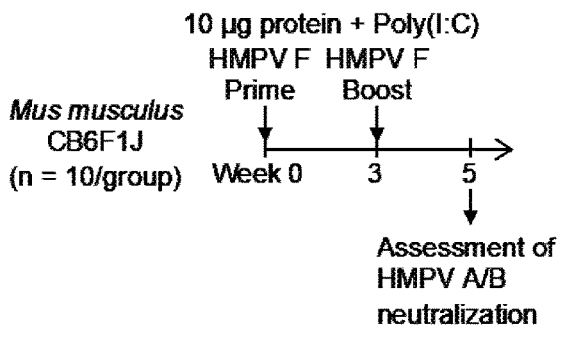
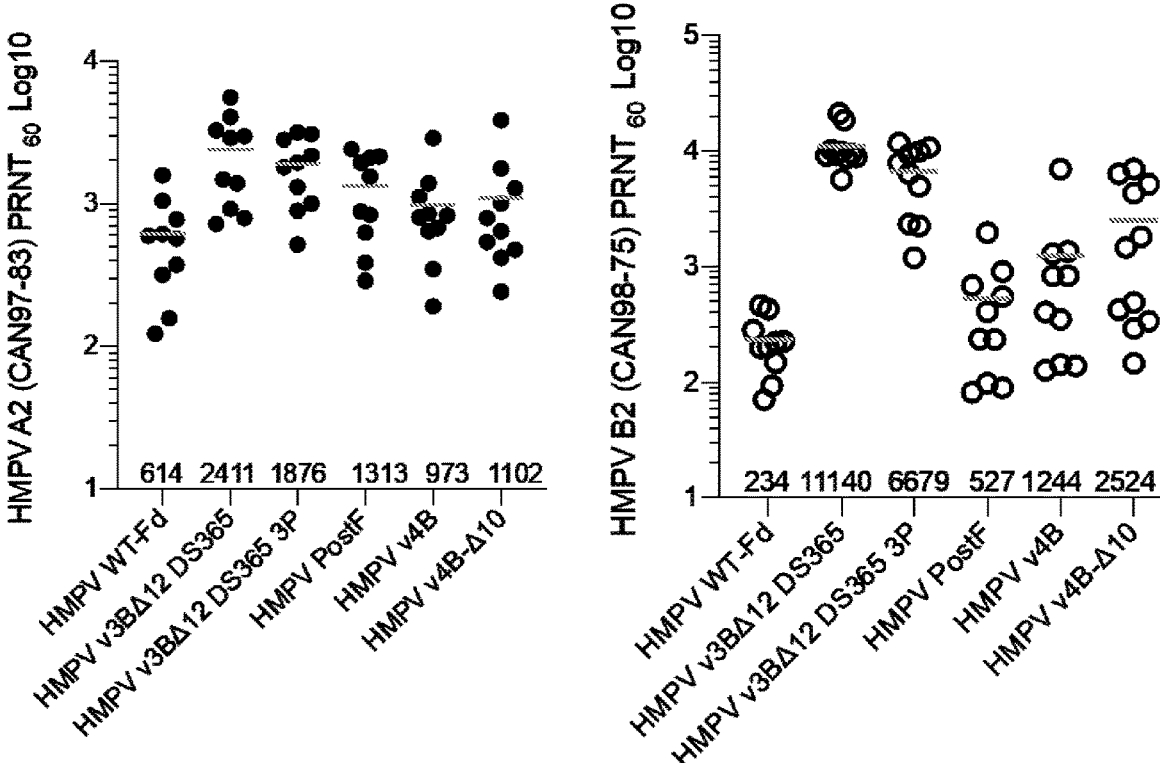

FIG. 25B
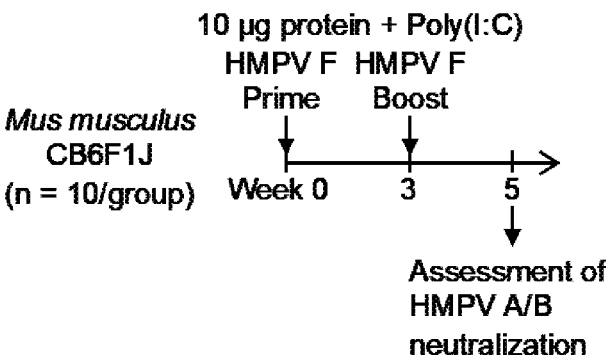
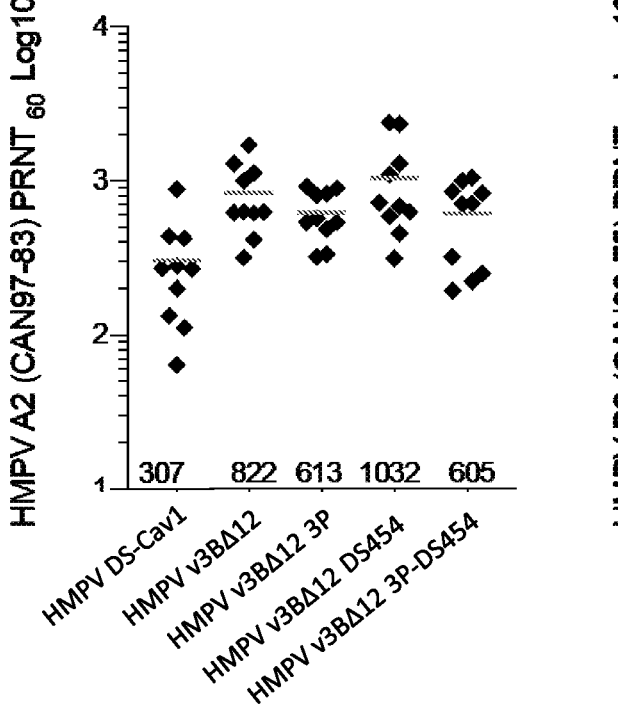
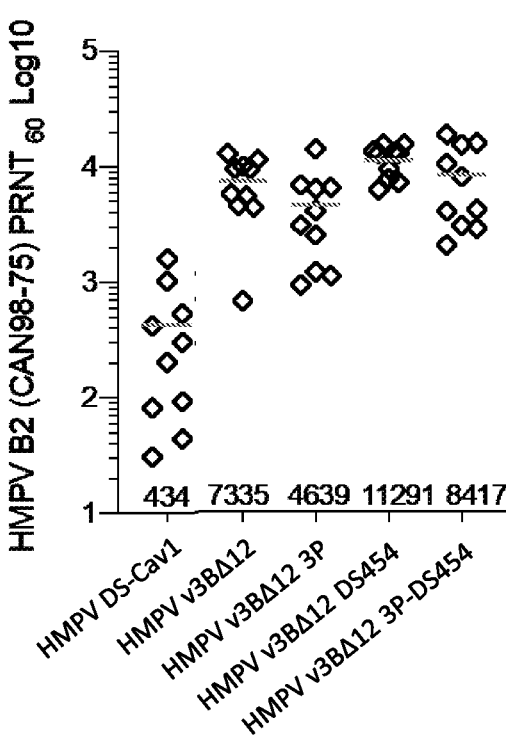

RECOMBINANT HUMAN METAPNEUMOVIRUS F PROTEINS AND THEIR USE

CROSS REFERENCE TO RELATED APPLICATIONS

This is the U.S. National Stage of International Application No. PCT/US2021/029988, filed Apr. 29, 2021, which was published in English under PCT Article 21(2), which in turn claims the benefit of U.S. Provisional Application No. 63,017,581, filed Apr. 29, 2020. The provisional application is incorporated by reference herein in its entirety.

FIELD

This disclosure relates to recombinant human metapneumovirus (HMPV) F proteins and immunogenic fragments thereof for treatment and prevention of HMPV infection and disease.

BACKGROUND

HMPV is an enveloped non-segmented negative-strand RNA virus in the family Paramyxoviridae, genus *Pneumovirus*. It is a common cause of bronchiolitis and pneumonia among children and the elderly. HMPV also causes repeated infections including severe lower respiratory tract disease, which may occur at any age, especially among the elderly or those with compromised cardiac, pulmonary, or immune systems. Current treatment includes administration of the anti-viral agent Ribaviran.

In nature, the HMPV F protein is initially expressed as a single polypeptide precursor, designated $F_0$. $F_0$ trimerizes in the endoplasmic reticulum and is proteolytically processed at a conserved cleavage site, generating $F_1$ and $F_2$ polypeptides. Three protomers of the $F_2$-$F_1$ heterodimer assemble to form a mature trimeric F protein, which adopts a metastable prefusion conformation that can be triggered to undergo a conformational change that fuses the viral and target-cell membranes. Due to its obligatory role in HMPV entry, the HMPV F protein is the target of neutralizing antibodies and the subject of vaccine development; however, like other HMPV antigens, prior efforts to develop an HMPV F protein-based vaccine have proven unsuccessful.

SUMMARY

Disclosed herein are recombinant HMPV F ectodomain trimers comprising protomers comprising one or more amino acid substitutions that introduce non-native disulfide bond to stabilize the F protein trimer in the prefusion conformation, or in the postfusion conformation. As described in the examples, such recombinant HMPV F ectodomain trimers elicit a superior immune response.

In some embodiments, a recombinant HMPV F ectodomain trimer is provided that is stabilized in a prefusion conformation by one or more amino acid substitutions in protomers of the trimer, the amino acid substitutions comprising cysteine substitutions at HMPV F positions 84 and 249 (such as V84C/A249C substitutions) that form a non-natural inter-protomer disulfide bond, or cysteine substitutions at HMPV F positions 140 and 147 (such as A140C/A147C substitutions) that form a non-natural intra-protomer disulfide bond, or cysteine substitutions at HMPV F positions 84 and 249 (such as V84C/A249C substitutions) that form a non-natural inter-protomer disulfide bond and cysteine substitutions at HMPV F positions 140 and 147 (such as A140C/A147C substitutions) that form a non-natural intra-protomer disulfide bond. In some embodiments, the one or more amino acid substitutions further comprise proline substitutions at one or more of HMPV F positions 131, 143, 145, 163, and 459, for example, the one or more amino acid substitutions further comprise E131P, R163P, and A459P substitutions. In some embodiments, the one or more amino acid substitutions further comprise cysteine substitutions at HMPV F positions 454 and 458 or HMPV F positions 365 and 455 to introduce a non-native disulfide bond. In additional embodiments, the one or more amino acid substitutions further comprise substitution of HMPV F positions 89-112 to GSGGSG (SEQ ID NO: 146) to remove a $F_1/F_2$ protease cleavage site.

In some embodiments, a recombinant HMPV F ectodomain trimer is provided that is stabilized in a postfusion conformation by one or more amino acid substitutions in protomers of the trimer, the amino acid substitutions comprising a cysteine substitution at HMPV F position 63 (such as a G63C substitution) that forms a non-natural intra-protomer disulfide bond with the cysteine at HMPV F position 60, or a cysteine substitution at HMPV F position 188 (such as a K188C substitution) that form a non-natural inter-protomer disulfide bond with the cysteine at HMPV F position 180, or a cysteine substitution at HMPV F position 63 (such as a G63C substitution) that forms a non-natural intra-protomer disulfide bond with the cysteine at HMPV F position 60 and a cysteine substitution at HMPV F position 188 (such as a K188C substitution) that form a non-natural inter-protomer disulfide bond with the cysteine at HMPV F position 180. In some embodiments, protomers of the recombinant HMPV F ectodomain trimer stabilized in the postfusion conformation further comprise cysteine substitutions at HMPV F positions 140, 147, 450, and/or 470 (such as A140C, A147C, K450C, and S470C substitutions).

In some embodiments, the protomers of the recombinant HMPV F ectodomain trimer further comprise one or more additional amino acid substitutions or deletions, such as amino acid substitutions that stabilize the recombinant HMPV F ectodomain trimer in the prefusion or postfusion conformation, or amino acid substitutions to inhibit or prevent protease cleavage at a F1/F2 protease cleavage site of the F ectodomain.

In some embodiments, the protomers of the recombinant HMPV F ectodomain trimer can be linked to a trimerization domain (such as T4 Fibritin trimerization domain). In additional embodiments, the protomers of the recombinant HMPV F ectodomain trimer can be membrane anchored, for example, by linkage to a transmembrane domain.

In additional embodiments, the recombinant HMPV F ectodomain trimer can be included on a self-assembling protein nanoparticle, such as a ferritin protein nanoparticle, or a synthetic protein-based nanoparticle. Nucleic acid molecules encoding a protomer of the disclosed recombinant HMPV F ectodomain trimers are also provided, as are vectors including the nucleic acid molecules, and methods of producing the disclosed recombinant HMPV F ectodomain trimers.

Immunogenic compositions including the recombinant HMPV F ectodomain trimer that are suitable for administration to a subject are also provided, and may also be contained in a unit dosage form. The compositions can further include an adjuvant. The recombinant HMPV F ectodomain trimers may also be conjugated to a carrier to facilitate presentation to the immune system.

Methods of inducing an immune response in a subject are disclosed, as are methods of treating, inhibiting or preventing a HMPV F infection in a subject, by administering to the subject an effective amount of a disclosed recombinant HMPV F ectodomain trimer, nucleic acid molecule, or vector.

The foregoing and other features and advantages of this disclosure will become more apparent from the following detailed description of several embodiments which proceeds with reference to the accompanying figures.

BRIEF DESCRIPTION OF THE FIGURES

FIGS. 1A-1D. Interprotomer disulfide-based stabilizing HMPV F trimer in a prefusion state. (FIG. 1A) Structure-based design of interprotomer disulfides based on the prefusion structure of HMPV F (PDB ID 5WB0). (FIG. 1B) Properties of disulfide-stabilized prefusion HMPV Fs. Left, expression level. Right, SDS-PAGE analysis of interprotomer disulfide-stabilized HMPV F prefusion variants without (−) and with (+) reducing agent (DTT, dithiothreitol). (FIG. 1C) Cryo-EM 3D reconstruction at 4.8 Å resolution of the MPE33 Fab in complex with HMPV F trimer stabilized with interprotomer 84C-249C and intraprotomer 140C-147C. Density is shown in transparent grey, with HMPV F in ribbons, shaded by distance between prefusion and postfusion conformation (based on the PDB 5wb0 and 5l1x). (FIG. 1D) Close-up of prefusion residues 113-179 in the "head" region, where there is clear density showing residues 113-179 to be in the prefusion conformation. The proximity of the 140/147 residues is shown.

(FIG. 2A) Properties of postfusion F proteins of HMPV subtypes A1 (NL/1/00) and B2 (CAN98-75) and corresponding HMPV F variants v4-A and v4-B. Left, expression levels. Right, SDS-PAGE analysis of postfusion and IP-DS-stabilized variants v4. (See FIG. 7 for construct details.) (FIG. 2B) Negative-strain electron micrographs of postfusion and IP-DS-stabilized variants v4 in subtype A and B. (FIG. 2C) Cryo-EM 3D reconstruction at 3.3 Å resolution of HMPV F v4-B. Left, Trimeric F with 3D-reconstruction density gray, HMPV F trimer displayed in ribbon and shaded by distance between postfusion and prefusion conformation. Right, 3D-reconstruction density for an HMPV F protomer displayed as or with trimer. (FIG. 2D) Enlarged view of the HMPV F v4-B apex, with engineered disulfide bonds shown in red (interprotomer) and magenta (intraprotomer) at an orientation 90 degrees from panel C (insert shows 182-188 disulfide with 3D-reconstruction density).

(FIG. 3A). Immunization regimen for CB6F1J mice (n=10/group) with two HMPV F immunizations followed by serum analysis at week 5. (FIG. 3B) Elicited HMPV F neutralization by prefusion F immunogens; experiment carried out in two sets of mice, one with v1-B and v3-B; a second with v2-B. (FIG. 3C) Elicited HMPV F neutralization by postfusion F immunogens; immunization experiment carried out in a single set of mice. (FIG. 3D) Comparison of titers elicited by IP-DS-stabilized prefusion and postfusion forms of hMPV F.

(FIG. 4A) Immunization regimen for rhesus (n=5/group) with two HMPV F immunizations followed by serum analysis at week 6. (FIG. 4B) Neutralizing responses graphed with geometric mean titers provided. (FIG. 4C) Neutralization titers from 12 human subjects. Adult human sera were assessed for HMPV plaque reduction neutralization titers using subtype A and subtype B HMPV viruses. Lines connect titers from the same donor. Geometric mean titers against A1 and B2 subtype viruses are provided.

(FIG. 5A) Serum antibody binding analysis for rhesus macaques immunized with HMPV postfusion F (post-B) or stabilized postfusion F v4-B (n=5/group) using two prefusion HMPV F (v1-B, v3-B) and two postfusion HMPV F versions (post-B, v4-B) as probes. (FIG. 5B) Neutralizing antibody responses for pooled rhesus serum (n=5/group) of each group was absorbed with prefusion (v3-B), postfusion (post-B), and interprotomer disulfide-stabilized postfusion HMPV F (v4-B) respectively.

FIGS. 7A-7D. (FIG. 7A) Summary of indicated HMPV F variants. (FIG. 7B) Antigenic recognition of HMPV F variants by MPE8, MPE33 and MPF5 (NB, no binding; ND, not done). (FIG. 7C-FIG. 7D) Sequences of HMPV F variants, cysteine mutations are highlighted in grey and residues that move more than 5 Å from the prefusion to postfusion transition are labeled by blue bar based on the PDB 5wb0 and 5l1x. The signal peptide and foldon are labeled by light grey bars, respectively. The sequences shown are v1-B (SEQ ID NO: 244), v2-B (SEQ ID NO: 245), v3-B (SEQ ID NO: 246), v4A (SEQ ID NO: 247), v5A (SEQ ID NO: 248), post-A (SEQ ID NO: 249), and post-B (SEQ ID NO: 250).

(FIG. 8A) HMPV F, v1-B. (FIG. 8B) HMPV F, v2-B. (FIG. 8C) HMPV F, v3-B. The prevalence of prefusion-like classes for v1-B was sample-preparation dependent, and in some cases clear postfusion-like classes were observed, such as the $3^{rd}$ image on the second row or the 1V image of the $3^{rd}$ row. By contrast, prefusion-like classes were prevalent for v2-B and v3-B. Scale bar: 10 nm.

(FIG. 9A) Schematic of HMPV F prefusion (left) and postfusion (right) trimer based on PDB IDs 5WB0 and 5LX1, respectively. Regions of conformational transition with greater than 5 Å movement colored dark grey, disordered regions are highlighted with a transparent box. (FIG. 9B) HMPV F variant 4 with disulfides in prefusion (modeled from 5WB0) and postfusion conformations. The schematic shows the sequence between signal peptide and foldon. Glycans are shown as branches on top of the boxes, and natural disulfide bonds are connected as gray lines under the boxes. Engineered cystine mutations are shown on top of the box. Engineered disulfides at 140-147 and 450-470 were not confirmed in the structure as they resided in disordered regions.

FIG. 11. Cryo-EM Data Collection and Refinement Statistics.

FIG. 12. Sequence alignment showing the design of different F1/F2 linkers.

FIG. 13. HMPV F v3B with the L0.1 F1/F2 linker binds to the prefusion specific antibody MPE8 and is in the prefusion conformation as assessed by negative stain EM. The L0.1 modification is a substitution of HMPV F positions 89-112 to GSGGSG (SEQ ID NO: 146), also referred to herein as the Δ12 mutation.

FIG. 14. Additional non-native disulfide bonds were introduced into HMPV F V3BΔ12 for prefusion stabilization.

FIGS. 15A and 15B. HMPV F V3BΔ12 with a D454C/V458C disulfide (FIG. 15A) or a T365C/Q455C disulfide (FIG. 15B) are expressed, purify as a single trimer pear by size exclusion chromatography, and are in the prefusion conformation as assessed by negative stain EM.

FIGS. 16 and 17. Antigenic assessment of HMPV F v3B variants.

FIGS. 19 and 20. HMPV F v3BΔ12 variants with the indicated proline mutations were expressed, purified as a single trimer peak on SEC, identified in the prefusion conformation by negative stain EM and MPE8 binding, and shown to contain interprotomer disulfide bonds by PAGE analysis.

FIG. 21. HMPV F v3BΔ12 variants with the indicated combinations of proline mutations were expressed and purified, with the yield shown. The yield of HMPV F v3BΔ12 with E131P, R163P, and A459P substitutions was approximately 100× that of HMPV F v3B.

FIGS. 22-24. Antigenic assessment of HMPV F v3BΔ12 variants with the indicated mutations.

FIGS. 25A and 25B. Immunogenicity assessment of HMPV F variants. CB6F1J mice were immunized twice with the indicated HMPV F variants, three weeks apart, and serum was collected at week 5 for neutralization analysis. All the immunogens were based on the subtype B2, CAN98-75 HMPV strain. All the immunogens were purified soluble HMPV F ectodomain trimer with a C-terminal T4 Fibritin trimerization domain and containing the indicated mutations for prefusion or postfusion stabilization. Serum neutralization activity was assessed against autologous strain CAN98-75 and heterologous strain CAN97-83. In a first neutralization assay (FIG. 25A), sera from mice immunized with HMPV F WT-Fd, HMPV F v3BΔ12 DS365, HMPV F v3BΔ12 DS365 3P, HMPV F PostF, HMPV F v4B, and HMPV F v4B-Δ10 was assessed. In a second assay (FIG. 25B), sera from mice immunized with HMPV F DS-Cav1, HMPV F v3BΔ12, HMPV F v3BΔ12 3P, HMPV F v3BΔ12 DS454, HMPV F v3BΔ12 3P-DS454 was assessed. "DS-Cav1" refers to A113C/A339C, T160F, and I177L substitutions, "v3BΔ12" refers to A140C/A147C, V84C/A249C, and 89-112GSGGSG substitutions, "DS454" refers to D454C/V458C substitutions, "DS365" refers to T365C/Q455C substitutions, "3P" refers to E131P, R163P, and A459P substitutions, "PostF" refers to 98-106RRRRR substitution, "V4B" refers to G63C, K188C, A140C/A147C, and 97-102GGGGGG substitutions, "V4B-Δ10" refers to G63C, K188C, A140C/A147C, 97-102GGGGGG substitutions, and Δ163-180 deletion. GGGGGG is SEQ ID NO: 147, GSGGSG is SEQ ID NO: 146, RRRRR is SEQ ID NO: 99.

SEQUENCES

Figure 1A:
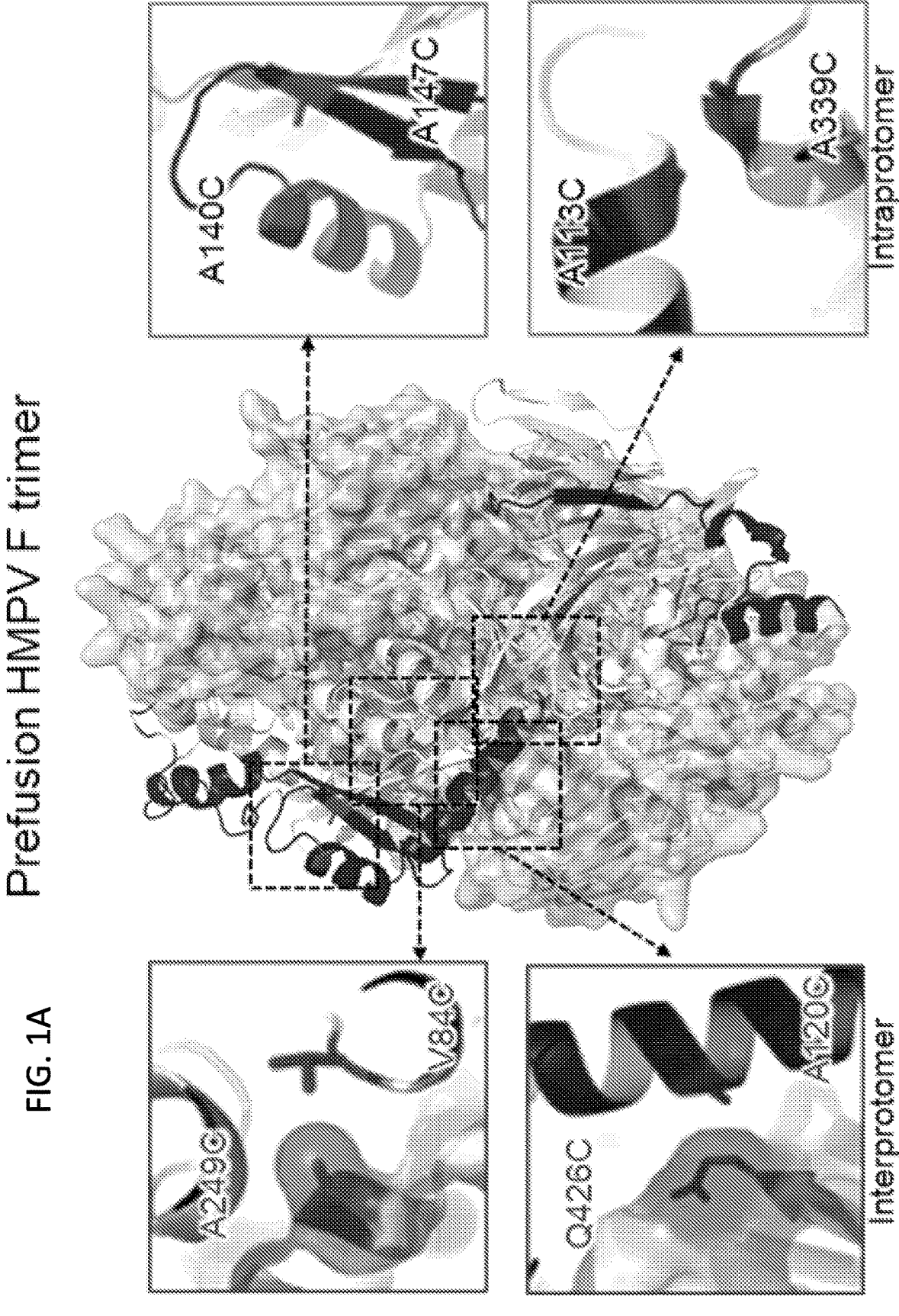

The nucleic and amino acid sequences are shown using standard letter abbreviations for nucleotide bases, and amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt" (~992 kb), which was created on Aug. 8, 2022 which is incorporated by reference herein. In the accompanying sequence listing:

DETAILED DESCRIPTION

This disclosure provides HMPV F ectodomain trimers that are stabilized in the prefusion or postfusion conformation and which are useful, for example, to elicit a neutralizing immune response in a subject.

I. Summary of Terms

Unless otherwise noted, technical terms are used according to conventional usage. Definitions of common terms in molecular biology may be found in Benjamin Lewin, *Genes X*, published by Jones & Bartlett Publishers, 2009; and Meyers et al. (eds.), *The Encyclopedia of Cell Biology and Molecular Medicine*, published by Wiley-VCH in 16 volumes, 2008; and other similar references.

As used herein, the singular forms "a," "an," and "the," refer to both the singular as well as plural, unless the context clearly indicates otherwise. As used herein, the term "comprises" means "includes." It is further to be understood that any and all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described herein. In case of conflict, the present specification, including explanations of terms, will control. In addition, the materials, methods, and examples are illustrative only and not intended to be limiting. To facilitate review of the various embodiments, the following explanations of terms are provided:

Adjuvant: A vehicle used to enhance antigenicity. Adjuvants include a suspension of minerals (alum, aluminum hydroxide, or phosphate) on which antigen is adsorbed; or water-in-oil emulsion, for example, in which antigen solution is emulsified in mineral oil (Freund incomplete adjuvant), sometimes with the inclusion of killed mycobacteria (Freund's complete adjuvant) to further enhance antigenicity (inhibits degradation of antigen and/or causes influx of macrophages). Immunostimulatory oligonucleotides (such as those including a CpG motif) can also be used as adjuvants. Adjuvants include biological molecules (a "biological adjuvant"), such as costimulatory molecules. Exemplary adjuvants include IL-2, RANTES, GM-CSF, TNF-α, IFN-γ, G-CSF, LFA-3, CD72, B7-1, B7-2, OX-40L, 4-1BBL, immune stimulating complex (ISCOM) matrix, and toll-like receptor (TLR) agonists, such as TLR-9 agonists, Poly I:C, or PolyICLC. The person of ordinary skill in the art is familiar with adjuvants (see, e.g., Singh (ed.)

Vaccine Adjuvants and Delivery Systems. Wiley-Interscience, 2007). Adjuvants can be used in combination with the disclosed HMPV F immunogens.

Administration: The introduction of a composition into a subject by a chosen route. Administration can be local or systemic. For example, if the chosen route is intravenous, the composition (such as a composition including a disclosed immunogen) is administered by introducing the composition into a vein of the subject. Exemplary routes of administration include, but are not limited to, oral, injection (such as subcutaneous, intramuscular, intradermal, intraperitoneal, and intravenous), sublingual, rectal, transdermal (for example, topical), intranasal, vaginal, and inhalation routes.

Amino acid substitution: The replacement of an amino acid in a polypeptide with one or more different amino acids. In the context of a protein sequence, an amino acid substitution is also referred to as a mutation.

Antibody: An immunoglobulin, antigen-binding fragment, or derivative thereof, that specifically binds and recognizes an analyte (antigen) such as HMPV F protein, an antigenic fragment thereof, or a dimer or multimer of the antigen. The term "antibody" is used herein in the broadest sense and encompasses various antibody structures, including but not limited to monoclonal antibodies, polyclonal antibodies, multispecific antibodies (e.g., bispecific antibodies), and antibody fragments, so long as they exhibit the desired antigen-binding activity. Non-limiting examples of antibodies include, for example, intact immunoglobulins and variants and fragments thereof that retain binding affinity for the antigen. Examples of antibody fragments include but are not limited to Fv, Fab, Fab', Fab'-SH, $F(ab')_2$; diabodies; linear antibodies; single-chain antibody molecules (e.g. scFv); and multispecific antibodies formed from antibody fragments. Antibody fragments include antigen binding fragments either produced by the modification of whole antibodies or those synthesized de novo using recombinant DNA methodologies (see, e.g., Kontermann and Dubel (Ed), Antibody Engineering, Vols. 1-2, $2^{nd}$ Ed., Springer Press, 2010).

Carrier: An immunogenic molecule to which an antigen can be linked. When linked to a carrier, the antigen may become more immunogenic. Carriers are chosen to increase the immunogenicity of the antigen and/or to elicit antibodies against the carrier which are diagnostically, analytically, and/or therapeutically beneficial. Useful carriers include polymeric carriers, which can be natural (for example, proteins from bacteria or viruses), semi-synthetic or synthetic materials containing one or more functional groups to which a reactant moiety can be attached.

Conditions sufficient to form an immune complex: Conditions which allow an antibody or antigen binding fragment thereof to bind to its cognate epitope to a detectably greater degree than, and/or to the substantial exclusion of, binding to substantially all other epitopes. Conditions sufficient to form an immune complex are dependent upon the format of the binding reaction and typically are those utilized in immunoassay protocols or those conditions encountered in vivo. See Harlow & Lane, Antibodies, A Laboratory Manual, $2^{nd}$ ed. Cold Spring Harbor Publications, New York (2013) for a description of immunoassay formats and conditions. The conditions employed in the methods are "physiological conditions" which include reference to conditions (e.g., temperature, osmolarity, pH) that are typical inside a living mammal or a mammalian cell. While it is recognized that some organs are subject to extreme conditions, the intra-organismal and intracellular environment normally lies around pH 7 (e.g., from pH 6.0 to pH 8.0, more typically pH 6.5 to 7.5), contains water as the predominant solvent, and exists at a temperature above 0° C. and below 50° C. Osmolarity is within the range that is supportive of cell viability and proliferation.

Conservative variants: "Conservative" amino acid substitutions are those substitutions that do not substantially affect or decrease a function of a protein, such as the ability of the protein to induce an immune response when administered to a subject. The term conservative variation also includes the use of a substituted amino acid in place of an unsubstituted parent amino acid. Furthermore, individual substitutions, deletions or additions which alter, add or delete a single amino acid or a small percentage of amino acids (for instance less than 5%, in some embodiments less than 1%) in an encoded sequence are conservative variations where the alterations result in the substitution of an amino acid with a chemically similar amino acid.

The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Non-conservative substitutions are those that reduce an activity or function of the recombinant HMPV F protein, such as the ability to induce an immune response when administered to a subject. For instance, if an amino acid residue is essential for a function of the protein, even an otherwise conservative substitution may disrupt that activity. Thus, a conservative substitution does not alter the basic function of a protein of interest.

Contacting: Placement in direct physical association; includes both in solid and liquid form, which can take place either in vivo or in vitro. Contacting includes contact between one molecule and another molecule, for example the amino acid on the surface of one polypeptide, such as a peptide, that contacts another polypeptide. Contacting can also include contacting a cell for example by placing a polypeptide in direct physical association with a cell.

Control: A reference standard. In some embodiments, the control is a negative control sample obtained from a healthy patient. In other embodiments, the control is a positive control sample obtained from a patient diagnosed with HMPV infection. In still other embodiments, the control is a historical control or standard reference value or range of values (such as a previously tested control sample, such as a group of HMPV patients with known prognosis or outcome, or group of samples that represent baseline or normal values).

A difference between a test sample and a control can be an increase or conversely a decrease. The difference can be a qualitative difference or a quantitative difference, for example a statistically significant difference. In some examples, a difference is an increase or decrease, relative to a control, of at least about 5%, such as at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 500%, or greater than 500%.

Detecting: To identify the existence, presence, or fact of something. General methods of detecting are known to the skilled artisan and may be supplemented with the protocols and reagents disclosed herein. For example, included herein are methods of detecting the level of a protein in a sample or a subject.

Epitope: An antigenic determinant. These are particular chemical groups or peptide sequences on a molecule that are antigenic, such that they elicit a specific immune response, for example, an epitope is the region of an antigen to which B and/or T cells respond. An antibody can bind to a particular antigenic epitope, such as an epitope on HMPV F.

Effective amount: An amount of agent, such as an immunogen, that is sufficient to elicit a desired response, such as an immune response in a subject. It is understood that to obtain a protective immune response against an antigen of interest can require multiple administrations of a disclosed immunogen, and/or administration of a disclosed immunogen as the "prime" in a prime boost protocol wherein the boost immunogen can be different from the prime immunogen. Accordingly, an effective amount of a disclosed immunogen can be the amount of the immunogen sufficient to elicit a priming immune response in a subject that can be subsequently boosted with the same or a different immunogen to elicit a protective immune response.

In one example, a desired response is to inhibit or reduce or prevent HMPV infection. The HMPV infection does not need to be completely eliminated or reduced or prevented for the method to be effective. For example, administration of an effective amount of the agent can decrease the HMPV infection (for example, as measured by infection of cells, or by number or percentage of subjects infected by HMPV) by a desired amount, for example by at least 50%, at least 60%, at least 70%, at least 80%, at least 90%, at least 95%, at least 98%, or even at least 100% (elimination or prevention of detectable HMPV infection), as compared to a suitable control.

It is understood that to obtain a protective immune response against a pathogen can require multiple administrations of the immunogenic composition. Thus, an effective amount encompasses a fractional dose that contributes in combination with previous or subsequent administrations to attaining a protective immune response. For example, a effective amount of an agent can be administered in a single dose, or in several doses, for example daily, during a course of treatment (such as a prime-boost vaccination treatment). However, the effective amount can depend on the subject being treated, the severity and type of the condition being treated, and the manner of administration. A unit dosage form of the agent can be packaged in a therapeutic amount, or in multiples of the therapeutic amount, for example, in a vial (e.g., with a pierceable lid) or syringe having sterile components.

Expression: Transcription or translation of a nucleic acid sequence. For example, a gene is expressed when its DNA is transcribed into an RNA or RNA fragment, which in some examples is processed to become mRNA. A gene may also be expressed when its mRNA is translated into an amino acid sequence, such as a protein or a protein fragment. In a particular example, a heterologous gene is expressed when it is transcribed into an RNA. In another example, a heterologous gene is expressed when its RNA is translated into an amino acid sequence. The term "expression" is used herein to denote either transcription or translation. Regulation of expression can include controls on transcription, translation, RNA transport and processing, degradation of intermediary molecules such as mRNA, or through activation, inactivation, compartmentalization or degradation of specific protein molecules after they are produced.

Expression Control Sequences: Nucleic acid sequences that regulate the expression of a heterologous nucleic acid sequence to which it is operatively linked. Expression control sequences are operatively linked to a nucleic acid sequence when the expression control sequences control and regulate the transcription and, as appropriate, translation of the nucleic acid sequence. Thus expression control sequences can include appropriate promoters, enhancers, transcription terminators, a start codon (ATG) in front of a protein-encoding gene, splicing signal for introns, maintenance of the correct reading frame of that gene to permit proper translation of mRNA, and stop codons. The term "control sequences" is intended to include, at a minimum, components whose presence can influence expression, and can also include additional components whose presence is advantageous, for example, leader sequences and fusion partner sequences. Expression control sequences can include a promoter.

A promoter is a minimal sequence sufficient to direct transcription. Also included are those promoter elements which are sufficient to render promoter-dependent gene expression controllable for cell-type specific, tissue-specific, or inducible by external signals or agents; such elements may be located in the 5' or 3' regions of the gene. Both constitutive and inducible promoters are included (see for example, Bitter et al., *Methods in Enzymology* 153:516-544, 1987). For example, when cloning in bacterial systems, inducible promoters such as pL of bacteriophage lambda, plac, ptrp, ptac (ptrp-lac hybrid promoter) and the like may be used. In one embodiment, when cloning in mammalian cell systems, promoters derived from the genome of mammalian cells (such as metallothionein promoter) or from mammalian viruses (such as the retrovirus long terminal repeat; the adenovirus late promoter; the vaccinia virus 7.5K promoter) can be used. Promoters produced by recombinant DNA or synthetic techniques may also be used to provide for transcription of the nucleic acid sequences.

Expression vector: A vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

GCN4 trimerization domain: A trimerization domain from the GCN4 protein that comprises a leucine zipper amino acid sequence that naturally forms a trimeric structure. Embodiments of the GCN4 trimerization domain is described, for example, Harbury et al. (1993 *Science* 262: 1401-1407). In some examples, a GCN4 trimerization domain can be included in the amino acid sequence of a disclosed recombinant protein so that the recombinant protein will trimerize. A non-limiting example of a GCN4 trimerization domain sequence for use with the disclosed embodiments is provided as KLMKQIEDKIEEILS-KIYHIENEIARIKKLIGEAP (SEQ ID NO: 92).

Heterologous: Originating from a different genetic source.

Host cells: Cells in which a vector can be propagated and its nucleic acid expressed. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Human Metapneumovirus (HMPV): An enveloped non-segmented negative-sense single-stranded RNA virus of the family Pneumoviridae, genus Metapneumovirus. It is a common cause of lower respiratory tract infections, including bronchiolitis and pneumonia, among children and adults and infects nearly all humans by five years of age. hMPV causes severe disease in infants and young children. Reinfections are common, and may cause severe lower respiratory tract disease, which may occur at any age, especially among the elderly or those with compromised cardiac, pulmonary, or immune systems.

The HMPV genome includes eight genes encoding nine proteins, including the glycoproteins SH, G and F. The F protein mediates fusion, allowing entry of the virus into the cell cytoplasm. Two groups of human HMPV strains have been described, the A and B groups, which are further divided into subgroups A1, A2, B1, and B2. Exemplary HMPV strain sequences are known to the person of ordinary skill in the art. Further, several models of human HMPV infection are available, including model organisms infected with HMPV (see, e.g., Herfst et al., J General Virol., 88, 2702-2709, 2007; Bayon et al., Rev. Med. Virol., 2, 15-34, 2013; and Liu et al., Clinical Vaccine Immunol., 20, 1246-1254, 2013).

Methods of diagnosing HMPV infection are known, including use of Direct Fluorescent Antibody detection (DFA), Chromatographic rapid antigen detection, and detection of viral RNA using RT PCR. Quantification of viral load can be determined, for example, by Plaque Assay, antigen capture enzyme immunoassay (EIA), or PCR. Quantification of antibody levels can be performed by subgroup-specific neutralization assay or ELISA. Current HMPV treatment includes use of the anti-viral Ribaviran. Additionally, passive administration of experimental monoclonal antibodies is under assessment, such as MPE8 (see, e.g., Corti et al., *Nature,* 501, 439-443, 2013) and mAb338 (Medimmune, Inc., see Hamelin et al., *Antiviral Res.,* 88, 31-37, 2010), which recognize the HMPV F protein and reduce incidence of HMPV infection and disease in animal models.

There are several subgroups of HMPV, including groups A and B, and subgroups A1, A2, B1, and B2 in human HMPV. Within the subgroups of HMPV, there are individual strains of each subgroup. Sequences of F proteins from particular HMPV strain are known and provided herein HMPV can be classified into two group: A and B. Groups A and B include subgroups A1, A2, B1, and B2, based mainly on sequence variability of the attachment (G) and fusion (F) proteins. The disclosed recombinant HMPV F proteins can be derived from any group (such as Group A or Group B) or subgroup of HMPV, such as subgroup A1, A2, B1, or B2.

HMPV Fusion (F) protein: An HMPV envelope glyco-protein that facilitates fusion of viral and cellular membranes. In nature, the HMPV F protein is initially synthesized as a single polypeptide precursor approximately 540 amino acids in length, designated $F_0$. $F_0$ includes an N-terminal signal peptide that directs localization to the endoplasmic reticulum, where the signal peptide (approximately the first 18 residues of $F_0$) is proteolytically cleaved. The remaining $F_0$ residues oligomerize to form a trimer which is again processed at a protease site (between approximately $F_0$ positions 102 and 103; for example, $RQSR_{102}$ (SEQ ID NO: 7, residues 99-102) to generate two disulfide-linked fragments, $F_1$ and $F_2$. The smaller of these fragments, $F_2$, originates from the N-terminal portion of the $F_0$ precursor and includes approximately residues 20-102 of $F_0$. The larger of these fragments, $F_1$, includes the C-terminal portion of the $F_0$ precursor (approximately residues 103-540) including an extracellular/lumenal region (~residues 103-490), a transmembrane domain (~residues 491-513), and a cytoplasmic domain (~residues 514-540) at the C-terminus.

Three $F_2$-$F_1$ protomers oligomerize in the mature F protein, which adopts a metastable "prefusion" conformation that is triggered to undergo a conformational change (to a "postfusion" conformation) upon contact with a target cell membrane. This conformational change exposes a hydrophobic sequence, known as the fusion peptide, which is located at the N-terminus of the $F_1$ polypeptide, and which associates with the host cell membrane and promotes fusion of the membrane of the virus, or an infected cell, with the target cell membrane.

The prefusion conformation of hMPF F is a structural conformation adopted by the HMPV F protein prior to triggering of the fusogenic event that leads to transition of HMPV F to the postfusion conformation and following processing into a mature HMPV F protein in the secretory system. The three-dimensional structure of an exemplary HMPV F protein in a prefusion conformation is provided as PDB. Acc. No. 5WB0, incorporated by reference herein as present in the data base on Mar. 2, 2020. In several embodiments, a recombinant HMPV F protein stabilized in the prefusion conformation specifically binds to an antibody (such as MPE8 antibody) specific for the trimeric form of the HMPV F ectodomain in the prefusion, but not postfusion, conformation.

The postfusion conformation of hMPF F is a structural conformation adopted by the HMPV F protein following the triggering of the fusogenic event. The three-dimensional structure of an exemplary HMPV F protein in a prefusion conformation is provided as PDB. Acc. No. 5L1X, incorporated by reference herein as present in the data base on Mar. 2, 2020. In several embodiments, a recombinant HMPV F protein stabilized in the postfusion conformation does not specifically bind to an antibody (such as MPE8 antibody) specific for the trimeric form of the HMPV F ectodomain in the prefusion conformation and does specifically bind to an antibody (such as MPE33 antibody) that binds to MPV F in both the prefusion and postfusion conformation.

The extracellular portion of the HMPV F protein is the HMPV F ectodomain, which includes the $F_2$ protein (approximately HMPV F positions 20-102) and the $F_1$ ectodomain (approximately HMPV F positions 103-490). An HMPV F ectodomain trimer includes a protein complex of three HMPV F ectodomains.

Immune response: A response of a cell of the immune system, such as a B cell, T cell, or monocyte, to a stimulus. In one embodiment, the response is specific for a particular antigen (an "antigen-specific response"). In one embodiment, an immune response is a T cell response, such as a CD4+ response or a CD8+ response. In another embodiment, the response is a B cell response, and results in the production of specific antibodies.

Immunogen: A compound, composition, or substance (for example, a recombinant HMPV F ectodomain trimer) that can elicit an immune response in an animal, including compositions that are injected or absorbed into an animal. Administration of an immunogen to a subject can lead to protective immunity against a pathogen of interest.

Immunogenic composition: A composition comprising a disclosed recombinant HMPV F ectodomain trimer that induces a measurable CTL response against the HMPV, or induces a measurable B cell response (such as production of antibodies) against the HMPV, when administered to a subject. It further refers to isolated nucleic acid molecules and vectors encoding a protomer of a disclosed recombinant HMPV F ectodomain trimer that can be used to express the protomer (and thus be used to elicit an immune response against recombinant HMPV F ectodomain trimer). For in vivo use, the immunogenic composition will typically include the recombinant HMPV F ectodomain trimer or a nucleic acid molecule encoding a protomer of the recombinant HMPV F ectodomain trimer in a pharmaceutically acceptable carrier and may also include other agents, such as an adjuvant.

Inhibiting or treating a disease: Inhibiting the full development of a disease or condition, for example, in a subject who is at risk for a disease such as HMPV infection. "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. Inhibiting a disease can include preventing or reducing the risk of the disease, such as preventing or reducing the risk of viral infection. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters that are specific to the particular disease. A "prophylactic" treatment is a treatment administered to a subject who does not exhibit signs of a disease or exhibits only early signs for the purpose of decreasing the risk of developing pathology.

Isolated: An "isolated" biological component has been substantially separated or purified away from other biological components, such as other biological components in which the component naturally occurs, such as other chromosomal and extrachromosomal DNA, RNA, and proteins. Proteins, peptides, nucleic acids, and viruses that have been "isolated" include those purified by standard purification methods. Isolated does not require absolute purity, and can include protein, peptide, nucleic acid, or virus molecules that are at least 50% isolated, such as at least 75%, 80%, 90%, 95%, 98%, 99%, or even 99.9% isolated.

Linker and Linked: A bi-functional molecule that can be used to link two molecules into one contiguous molecule. Non-limiting examples of peptide linkers include glycine-serine peptide linkers. Unless context indicates otherwise, reference to "linking" a first polypeptide and a second polypeptide, or to two polypeptides "linked" together, or to a first polypeptide having a "linkage" to a second polypeptide, refers to covalent linkage by peptide bond (for example via a peptide linker) such that the first and second polypeptides form a contiguous polypeptide chain. If a peptide linker is involved, the covalent linkage of the first and second polypeptides can be to the N- and C-termini of the peptide linker. Typically, such linkage is accomplished using molecular biology techniques to genetically manipulate DNA encoding the first polypeptide linked to the second polypeptide by the peptide linker.

MPE8 Antibody: A neutralizing monoclonal antibody that specifically binds to an epitope on HMPV F protein that is present on the prefusion, but not the postfusion conformation, of the HMPV F protein. Thus, the MPE8 antibody does not specifically bind to HMPV F in its postfusion conformation. The MPE8 antibody and methods for its production are described, for example, in Corti et al. (Nature, 501, 439-443, 2013), which is incorporated by reference herein. The amino acid sequences of the heavy and light variable regions of the MPE8 antibody used herein are provided as SEQ ID NOs: 93 and 94. MPE8 heavy and light chain sequences have been deposited in GenBank as Nos. AGU13651.1 (MPE8 $V_H$) and AGU13652.1 (MPE8 $V_L$), each of which is incorporated by reference herein as present in the database on Mar. 2, 2020).

```
MPE8 VH
                                          (SEQ ID NO: 93)
EVQLVESGGGLVKPGGSLRLSCAASGFTFSSYSMNWVRQAPGKGLEWVSS

ISASSSYSDYADSAKGRFTISRDNAKTSLFLQMNSLRAEDTAIYFCARAR

ATGYSSITPYFDIWGQGTLVTVSS

MPE8 VL
                                          (SEQ ID NO: 94)
QSVVTQPPSVSGAPGQRVTISCTGSSSNIGAGYDVHWYQQLPGTAPKLLI

YDNNNRPSGVPDRESASKSGTSASLAITGLQAEDEADYYCQSYDRSLSGV

FGTGTKVTVL
```

Native protein, sequence, or disulfide bond: A polypeptide, sequence or disulfide bond that has not been modified, for example, by selective mutation. For example, selective mutation to focus the antigenicity of the antigen to a target epitope, or to introduce a disulfide bond into a protein that does not occur in the native protein. Native protein or native sequence are also referred to as wild-type protein or wild-type sequence. A non-native disulfide bond is a disulfide bond that is not present in a native protein, for example, a disulfide bond that forms in a protein due to introduction of one or more cysteine residues into the protein by genetic engineering.

Neutralizing antibody: An antibody which reduces the infectious titer of an infectious agent by binding to a specific antigen on the infectious agent. In some examples the infectious agent is a virus. In some examples, an antibody that is specific for HMPV F neutralizes the infectious titer of HMPV. A "broadly neutralizing antibody" is an antibody that binds to and inhibits the function of related antigens, such as antigens that share at least 85%, 90%, 95%, 96%, 97%, 98% or 99% identity antigenic surface of antigen. With regard to an antigen from a pathogen, such as a virus, the antibody can bind to and inhibit the function of an antigen from more than one class and/or subclass of the pathogen. For example, with regard to HMPV, the antibody can bind to and inhibit the function of an antigen, such as HMPV F from more than one group. In one embodiment, broadly neutralizing antibodies to HMPV are distinct from other antibodies to HMPV in that they neutralize a high percentage of the many types of HMPV in circulation.

Nucleic acid molecule: A polymeric form of nucleotides, which may include both sense and anti-sense strands of RNA, cDNA, genomic DNA, and synthetic forms and mixed polymers of the above. A nucleotide refers to a ribonucleotide, deoxynucleotide or a modified form of either type of nucleotide. The term "nucleic acid molecule" as used herein is synonymous with "nucleic acid" and "polynucleotide." A nucleic acid molecule is usually at least 10 bases in length, unless otherwise specified. The term includes single- and double-stranded forms of DNA. A polynucleotide may include either or both naturally occurring and modified nucleotides linked together by naturally occurring and/or non-naturally occurring nucleotide linkages. "cDNA" refers to a DNA that is complementary or identical to an mRNA, in either single stranded or double stranded form. "Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom.

Operably linked: A first nucleic acid sequence is operably linked with a second nucleic acid sequence when the first nucleic acid sequence is placed in a functional relationship with the second nucleic acid sequence. For instance, a promoter, such as the CMV promoter, is operably linked to a coding sequence if the promoter affects the transcription or expression of the coding sequence. Generally, operably linked DNA sequences are contiguous and, where necessary to join two protein-coding regions, in the same reading frame.

Pharmaceutically acceptable carriers: The pharmaceutically acceptable carriers of use are conventional. Remington's Pharmaceutical Sciences, by E. W. Martin, Mack Publishing Co., Easton, PA, 19th Edition, 1995, describes compositions and formulations suitable for pharmaceutical delivery of the disclosed immunogens.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate. In particular embodiments, suitable for administration to a subject the carrier may be sterile, and/or suspended or otherwise contained in a unit dosage form containing one or more measured doses of the composition suitable to induce the desired anti-MPV immune response. It may also be accompanied by medications for its use for treatment purposes. The unit dosage form may be, for example, in a sealed vial that contains sterile contents or a syringe for injection into a subject, or lyophilized for subsequent solubilization and administration or in a solid or controlled release dosage.

Polypeptide: Any chain of amino acids, regardless of length or post-translational modification (e.g., glycosylation or phosphorylation). "Polypeptide" applies to amino acid polymers including naturally occurring amino acid polymers and non-naturally occurring amino acid polymer as well as in which one or more amino acid residue is a non-natural amino acid, for example, an artificial chemical mimetic of a corresponding naturally occurring amino acid. A "residue" refers to an amino acid or amino acid mimetic incorporated in a polypeptide by an amide bond or amide bond mimetic. A polypeptide has an amino terminal (N-terminal) end and a carboxy terminal (C-terminal) end. "Polypeptide" is used interchangeably with peptide or protein, and is used herein to refer to a polymer of amino acid residues.

Prime-boost vaccination: An immunotherapy including administration of a first immunogenic composition (the primer vaccine) followed by administration of a second immunogenic composition (the booster vaccine) to a subject to induce an immune response. The primer vaccine and/or the booster vaccine include a vector (such as a viral vector, RNA, or DNA vector) expressing the antigen to which the immune response is directed. The booster vaccine is administered to the subject after the primer vaccine; a suitable time interval between administration of the primer vaccine and the booster vaccine, and examples of such timeframes are disclosed herein. In some embodiments, the primer vaccine, the booster vaccine, or both primer vaccine and the booster vaccine additionally include an adjuvant. In one non-limiting example, the primer vaccine is a DNA-based vaccine (or other vaccine based on gene delivery), and the booster vaccine is a protein subunit or protein nanoparticle based vaccine.

Protein nanoparticle: A self-assembling, multi-subunit, protein-based polyhedron shaped structure. The subunits are each composed of proteins or polypeptides (for example a glycosylated polypeptide), and, optionally of single or multiple features of the following: nucleic acids, prosthetic groups, organic and inorganic compounds. Non-limiting examples of protein nanoparticles include ferritin nanoparticles (see, e.g., Zhang, Y. Int. J. Mol. Sci., 12:5406-5421, 2011, incorporated by reference herein), encapsulin nanoparticles (see, e.g., Sutter et al., Nature Struct. and Mol. Biol., 15:939-947, 2008, incorporated by reference herein), Sulfur Oxygenase Reductase (SOR) nanoparticles (see, e.g., Urich et al., Science, 311:996-1000, 2006, incorporated by reference herein), lumazine synthase nanoparticles (see, e.g., Zhang et al., J. Mol. Biol., 306: 1099-1114, 2001) or pyruvate dehydrogenase nanoparticles (see, e.g., Izard et al., PNAS 96: 1240-1245, 1999, incorporated by reference herein). Ferritin, encapsulin, SOR, lumazine synthase, and pyruvate dehydrogenase are monomeric proteins that self-assemble into a globular protein complexes that in some cases consists of 24, 60, 24, 60, and 60 protein subunits, respectively. In some examples, ferritin, encapsulin, SOR, lumazine synthase, or pyruvate dehydrogenase monomers are linked to a recombinant HMPV F ectodomain and self-assemble into a protein nanoparticle presenting the recombinant HMPV F ectodomain trimer on its surface, which can be administered to a subject to stimulate an immune response to the antigen. Additional protein nanoparticle structures are described by Heinze et al., J Phys Chem B., 120(26):5945-52, 2016; Hsia et al., Nature, 535 (7610):136-9, 2016; and King et al., Nature, 510(7503):103-8, 2014; each of which is incorporated by reference herein.

Recombinant: A recombinant nucleic acid molecule is one that has a sequence that is not naturally occurring, for example, includes one or more nucleic acid substitutions, deletions or insertions, and/or has a sequence that is made by an artificial combination of two otherwise separated segments of sequence. This artificial combination can be accomplished by chemical synthesis or, more commonly, by the artificial manipulation of isolated segments of nucleic acids, for example, by genetic engineering techniques.

A recombinant virus is one that includes a genome that includes a recombinant nucleic acid molecule.

A recombinant protein is one that has a sequence that is not naturally occurring or has a sequence that is made by an artificial combination of two otherwise separated segments of sequence. In several embodiments, a recombinant protein is encoded by a heterologous (for example, recombinant) nucleic acid that has been introduced into a host cell, such as a bacterial or eukaryotic cell, or into the genome of a recombinant virus.

Sequence identity: The similarity between amino acid sequences is expressed in terms of the similarity between the sequences, otherwise referred to as sequence identity. Sequence identity is frequently measured in terms of percentage identity; the higher the percentage, the more similar the two sequences are. Homologs, orthologs, or variants of a polypeptide will possess a relatively high degree of sequence identity when aligned using standard methods.

Methods of alignment of sequences for comparison are well known in the art. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci. USA* 85:2444, 1988; Higgins & Sharp, *Gene,* 73:237-44, 1988; Higgins & Sharp, *CABIOS* 5:151-3, 1989; Corpet et al., *Nuc. Acids Res.* 16:10881-90, 1988; Huang et al. *Computer Appls. In the Biosciences* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations.

Variants of a polypeptide are typically characterized by possession of at least about 75%, for example, at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet.

As used herein, reference to "at least 90% identity" (or similar language) refers to "at least 90%, at least 91%, at least 92%, at least 93%, at least 94%, at least 95%, at least 96%, at least 97%, at least 98%, at least 99%, or even 100% identity" to a specified reference sequence.

Single chain HMPV F protein: A recombinant HMPV F protein that is expressed as a single polypeptide chain including the HMPV $F_1$ ectodomain and the HMPV $F_2$ polypeptide. The single chain HMPV F protein can trimerize to form a trimeric HMPV F protein. A single chain HMPV F protein does not include a protease cleave site between the $F_1$ and $F_2$ polypeptides and is not cleaved into separate $F_1$ and $F_2$ polypeptides when produced in cells. In one embodiment, HMPV F positions 98 and 103 are linked with a heterologous peptide linker to generate the single chain construction.

Signal Peptide: A short amino acid sequence (e.g., approximately 18-25 amino acids in length) that directs newly synthesized secretory or membrane proteins to and through membranes (for example, the endoplasmic reticulum membrane). Signal peptides are typically located at the N-terminus of a polypeptide and are removed by signal peptidases after the polypeptide has crossed the membrane. Signal peptide sequences typically contain three common structural features: an N-terminal polar basic region (n-region), a hydrophobic core, and a hydrophilic c-region). An exemplary signal peptide sequence is set forth as residues 1-18 of SEQ ID NO: 7 (HMPV F signal peptide).

Specifically bind: When referring to the formation of an antibody:antigen protein complex, or a protein:protein complex, refers to a binding reaction which determines the presence of a target protein, peptide, or polysaccharide (for example, a glycoprotein), in the presence of a heterogeneous population of proteins and other biologics. Thus, under designated conditions, a particular antibody or protein binds preferentially to a particular target protein, peptide or polysaccharide (such as an antigen present on the surface of a pathogen, for example, an antigenic site at the membrane distal apex of the HMPV F ectodomain timer) and does not bind in a significant amount to other proteins or polysaccharides present in the sample or subject. Specific binding can be determined by methods known in the art. A first protein or antibody specifically binds to a target protein when the interaction has a $K_D$ of less than $10^{-6}$ Molar, such as less than $10^{-7}$ Molar, less than $10^{-8}$ Molar, less than $10^{-9}$, or even less than $10^{-10}$ Molar.

Soluble protein: A protein capable of dissolving in aqueous liquid at room temperature and remaining dissolved. The solubility of a protein may change depending on the concentration of the protein in the water-based liquid, the buffering condition of the liquid, the concentration of other solutes in the liquid, for example salt and protein concentrations, and the heat of the liquid. In several embodiments, a soluble protein is one that dissolves to a concentration of at least 0.5 mg/ml in phosphate buffered saline (pH 7.4) at room temperature and remains dissolved for at least 48 hours.

Subject: Living multi-cellular vertebrate organisms, a category that includes human and non-human mammals. In an example, a subject is a human. In a particular example, the subject is a newborn infant. In an additional example, a subject is selected that is in need of inhibiting of an HMPV infection. For example, the subject is either uninfected and at risk of HMPV infection or is infected in need of treatment.

T4 fibritin trimerization domain: Also referred to as a "foldon" domain, the T4 fibritin trimerization domain comprises an amino acid sequence that naturally forms a trimeric structure. In some examples, a T4 fibritin trimerization domain can be included in the amino acid sequence of a disclosed recombinant protein so that the antigen will form a trimer. In one example, a T4 fibritin trimerization domain comprises the amino acid sequence set forth as (GYIPEAPRDGQAYVRKDGEWVLLSTF (SEQ ID NO: 96). Several embodiments include a T4 fibritin trimerization domain that can be cleaved from a purified protein, for example by incorporation of a thrombin cleave site adjacent to the T4 fibritin trimerization domain that can be used for cleavage purposes.

Transmembrane domain: An amino acid sequence that inserts into a lipid bilayer, such as the lipid bilayer of a cell or virus or virus-like particle. A transmembrane domain can be used to anchor an antigen to a membrane. In some examples a transmembrane domain is a HMPV F transmembrane domain.

Under conditions sufficient for: A phrase that is used to describe any environment that permits a desired activity.

Vaccine: A preparation of immunogenic material capable of stimulating an immune response, administered for the prevention, amelioration, or treatment of infectious or other types of disease. The immunogenic material may include attenuated or killed microorganisms (such as bacteria or viruses), or antigenic proteins, peptides, or DNA derived from them. A vaccine may include a disclosed immunogen (such as a recombinant HMPV F ectodomain trimer or nucleic acid molecule encoding same), a virus, a cell or one or more cellular constituents. Vaccines may elicit both prophylactic (preventative or protective) and therapeutic responses. Methods of administration vary according to the vaccine, but may include inoculation, ingestion, inhalation or other forms of administration. Vaccines may be administered with an adjuvant to boost the immune response. In one specific, non-limiting example, a vaccine prevents and/or reduces the severity of the symptoms associated with HMPV infection and/or decreases the viral load compared to a control.

Vector: An entity containing a DNA or RNA molecule bearing a promoter(s) that is operationally linked to the coding sequence of an antigen(s) of interest and can express the coding sequence. Non-limiting examples include a naked or packaged (lipid and/or protein) DNA, a naked or packaged RNA, a subcomponent of a virus or bacterium or other microorganism that may be replication-incompetent, or a virus or bacterium or other microorganism that may be replication-competent. A vector is sometimes referred to as a construct. Recombinant DNA vectors are vectors having recombinant DNA. A vector can include nucleic acid sequences that permit it to replicate in a host cell, such as an origin of replication. A vector can also include one or more selectable marker genes and other genetic elements known in the art. Viral vectors are recombinant nucleic acid vectors having at least some nucleic acid sequences derived from one or more viruses.

Virus-like particle (VLP): A non-replicating, viral shell, derived from any of several viruses. VLPs are generally composed of one or more viral proteins, such as, but not limited to, those proteins referred to as capsid, coat, shell, surface and/or envelope proteins, or particle-forming polypeptides derived from these proteins. VLPs can form spontaneously upon recombinant expression of the protein in an appropriate expression system. Methods for producing particular VLPs are known in the art. The presence of VLPs following recombinant expression of viral proteins can be detected using conventional techniques known in the art, such as by electron microscopy, biophysical characterization, and the like. Further, VLPs can be isolated by known techniques, e.g., density gradient centrifugation and identified by characteristic density banding. See, for example, Baker et al. (1991) *Biophys. J.* 60:1445-1456; and Hagensee et al. (1994) *J. Virol.* 68:4503-4505; Vincente, *J Invertebr Pathol.*, 2011; Schneider-Ohrum and Ross, *Curr. Top. Microbiol. Immunol.*, 354: 53073, 2012).

II. Recombinant HMPV F Ectodomain Trimers

The HMPV F trimer is understood to undergo dramatic structural rearrangement between its prefusion and postfusion conformations. In the prefusion conformation, the HMPV F trimer includes a "cap" at its membrane distal apex, with the three protomers of the F trimer coming together, and the N-terminus of the $F_1$ polypeptide (which includes the fusion peptide that is inserted in to target cell membrane) buried in the core of the F protein trimer. In the postfusion conformation, F protein trimer forms a cylindrical shape, with rearrangements of the fusion peptide extending distally.

Recombinant HMPV F ectodomain trimers are disclosed herein that are modified from a native form (e.g., by introduction of one or more amino acid substitutions) to be stabilized or "locked" in the prefusion or postfusion conformation. As described in the Examples, embodiments of the disclosed HMPV F ectodomain trimers have been selected through multiple rounds of structure based design for optimized solubility, stability, expression, and immunogenicity. The recombinant HMPV F ectodomain trimers are useful to induce an immune response in a vertebrate animal (such humans) to HMPV. Exemplary embodiments are shown to produce a superior immune response in an animal model compared to corresponding HMPV F ectodomain trimers that are not stabilized in the prefusion or postfusion conformation.

Native HMPV F proteins from different HMPV strains, as well as nucleic acid sequences encoding such proteins and methods, are known and can be altered using the description provided herein to generate a recombinant HMPV F ectodomain trimer stabilized in the prefusion or postfusion conformation. Non-limiting examples of native HMPV F sequence are provided as SEQ ID NOs: 1-7, below.

```
NL/1/00 (Subgroup A1, SEQ ID NO: 1, GenBank:
AAK62968.2)
MSWKVVIIFSLLITPQHGLKESYLEESCSTITEGYLSVLRTGWYTNVFTL

EVGDVENLTCADGPSLIKTELDLTKSALRELRTVSADQLAREEQIENPRQ

SRFVLGAIALGVATAAAVTAGVAIAKTIRLESEVTAIKNALKKTNEAVST

LGNGVRVLATAVRELKDFVSKNLTRAINKNKCDIADLKMAVSFSQFNRRF

LNVVRQFSDNAGITPAISLDLMTDAELARAVSNMPTSAGQIKLMLENRAM

VRRKGFGFLIGVYGSSVIYMVQLPIFGVIDTPCWIVKAAPSCSGKKGNYA

CLLREDQGWYCQNAGSTVYYPNEKDCETRGDHVFCDTAAGINVAEQSKEC

NINISTTNYPCKVSTGRHPISMVALSPLGALVACYKGVSCSIGSNRVGII

KQLNKGCSYITNQDADTVTIDNTVYQLSKVEGEQHVIKGRPVSSSFDPVK

FPEDQFNVALDQVFESIENSQALVDQSNRILSSAEKGNTGFIIVIILIAV

LGSTMILVSVFIIIKKTKKPTGAPPELSGVTNNGFIPHN

CAN97-83 (Subgroup A2, SEQ ID NO: 2, Uniprot
Q6WB98)
MSWKVVIIFSLLITPQHGLKESYLEESCSTITEGYLSVLRTGWYTNVFTL

EVGDVENLTCSDGPSLIKTELDLTKSALRELKTVSADQLAREEQIENPRQ

SRFVLGAIALGVATAAAVTAGVAIAKTIRLESEVTAIKNALKTTNEAVST

LGNGVRVLATAVRELKDFVSKNLTRAINKNKCDIDDLKMAVSFSQFNRRF

LNVVRQFSDNAGITPAISLDLMTDAELARAVSNMPTSAGQIKLMLENRAM

VRRKGFGILIGVYGSSVIYMVQLPIFGVIDTPCWIVKAAPSCSGKKGNYA

CLLREDQGWYCQNAGSTVYYPNEKDCETRGDHVFCDTAAGINVAEQSKEC

NINISTTNYPCKVSTGRHPISMVALSPLGALVACYKGVSCSIGSNRVGII

KQLNKGCSYITNQDADTVTIDNTVYQLSKVEGEQHVIKGRPVSSSFDPIK

FPEDQFNVALDQVFENIENSQALVDQSNRILSSAEKGNTGFIIVIILIAV

LGSSMILVSIFIIIKKTKKPTGAPPELSGVTNNGFIPHS

NL/17/00 (Subgroup A2, SEQ ID NO: 3, GenBank:
AY304360.1)
MSWKVVIIFSLLITPQHGLKESYLEESCSTITEGYLSVLRTGWYTNVFTL

EVGDVENLTCSDGPSLIKTELDLTKSALRELKTVSADQLAREEQIENPRQ

SRFVLGAIALGVATAAAVTAGVAIAKTIRLESEVTAIKNALKTTNEAVST

LGNGVRVLATAVRELKDFVSKNLTRAINKNKCDIDDLKMAVSFSQFNRRF

LNVVRQFSDNAGITPAISLDLMTDAELARAVSNMPTSAGQIKLMLENRAM

VRRKGFGILIGVYGSSVIYTVQLPIFGVIDTPCWIVKAAPSCSEKKGNYA
```

-continued

```
CLLREDQGWYCQNAGSTVYYPNEKDCETRGDHVFCDTAAGINVAEQSKEC

NINISTTNYPCKVSTGRHPISMVALSPLGALVACYKGVSCSIGSNRVGII

KQLNKGCSYITNQDADTVTIDNTVYQLSKVEGEQHVIKGRPVSSSFDPIK

FPEDQFNVALDQVFENIENSQALVDQSNRILSSAEKGNTGFIIVIILIAV

LGSSMILVSIFIIIKKTKKPTGAPPELSGVTNNGFIPHS
```

NCL174 (Subgroup A2, SEQ ID NO: 4, Uniprot
G0ZRI7)
```
MSWKVVIIFSLLITPQHSLKESYLEESCSTITEGYLSVLRTGWYTNVFTL

EVGDVENLTCADGPSLIKTELDLTKSALRELKPVSADQLAREEQIENPRQ

SRFVLGAIALGVATAAAVTAGVAIAKTIRLESEVTAIKNALKKTNEAVST

LGNGVRVLATAVRELKDFVSKNLTRAINKNKCDIDDLKMAVSFSQFNRRF

LNVVRQFSDNAGITPAISLDLMTDAELARAVSNMPTAAGQIKLMLENRAM

VRRKGFGILIGVYGSSVIYMVQLPIFGVIDTPCWIVKAAPSCSEKKGNYA

CLLREDQGWYCQNAGSTVYYPNEKDCETRGDHVFCDTAAGINVAEQSKEC

NINISTTNYPCKVSTGRHPISMVALSPLGALVACYKGVSCSIGSNRVGII

KQLNKGCSYITNQDADTVTIDNTVYQLSKVEGEQHVIKGRPVSSSFDPVK

FPEDQFNVALDQVFENIENSQALVDQSNRILSSAEKGNTGFIIVIILIAV

LGSSMILVSVFIIIKKTRKPTGAPPELSGVTNNGFIPHS
```

NL/1/99 (Subgroup B1, SEQ ID NO: 5, GenBank:
AY304361.1)
```
MSWKVMIIISLLITPQHGLKESYLEESCSTITEGYLSVLRTGWYTNVFTL

EVGDVENLTCTDGPSLIKTELDLTKSALRELKTVSADQLAREEQIENPRQ

SRFVLGAIALGVATAAAVTAGIAIAKTIRLESEVNAIKGALKQTNEAVST

LGNGVRVLATAVRELKEFVSKNLTSAINRNKCDIADLKMAVSFSQFNRRF

LNVVRQFSDNAGITPAISLDLMTDAELARAVSYMPTSAGQIKLMLENRAM

VRRKGFGILIGVYGSSVIYMVQLPIFGVIDTPCWIIKAAPSCSEKNGNYA

CLLREDQGWYCKNAGSTVYYPNEKDCETRGDHVFCDTAAGINVAEQSREC

NINISTTNYPCKVSTGRHPISMVALSPLGALVACYKGVSCSIGSNWVGII

KQLPKGCSYITNQDADTVTIDNTVYQLSKVEGEQHVIKGRPVSSSFDPIK

FPEDQFNVALDQVFESIENSQALVDQSNKILNSAEKGNTGFIIVVILVAV

LGLTMISVSIIIIIKKTRKPTGAPPELNGVTNGGFIPHS
```

NDL00-1 (Subgroup B1, SEQ ID NO: 6, GenBank:
AAK62968.2)
```
MSWKVVIIFSLLITPQHGLKESYLEESCSTITEGYLSVLRTGWYTNVFTL

EVGDVENLTCADGPSLIKTELDLTKSALRELRTVSADQLAREEQIENPRQ

SRFVLGAIALGVATAAAVTAGVAIAKTIRLESEVTAIKNALKKTNEAVST

LGNGVRVLATAVRELKDFVSKNLTRAINKNKCDIADLKMAVSFSQFNRRF

LNVVRQFSDNAGITPAISLDLMTDAELARAVSNMPTSAGQIKLMLENRAM

VRRKGFGFLIGVYGSSVIYMVQLPIFGVIDTPCWIVKAAPSCSGKKGNYA

CLLREDQGWYCQNAGSTVYYPNEKDCETRGDHVFCDTAAGINVAEQSKEC

NINISTTNYPCKVSTGRHPISMVALSPLGALVACYKGVSCSIGSNRVGII

KQLNKGCSYITNQDADTVTIDNTVYQLSKVEGEQHVIKGRPVSSSFDPVK
```

-continued

```
FPEDQFNVALDQVFESIENSQALVDQSNRILSSAEKGNTGFIIVIILIAV

LGSTMILVSVFIIIKKTKKPTGAPPELSGVTNNGFIPHN
```

CAN98-75 (Subgroup B2, SEQ ID NO: 7, Uniprot:
Q6WBA7)
```
MSWKVMIIISLLITPQHGLKESYLEESCSTITEGYLSVLRTGWYTNVFTL

EVGDVENLTCTDGPSLIKTELDLTKSALRELKTVSADQLAREEQIENPRQ

SRFVLGAIALGVATAAAVTAGIAIAKTIRLESEVNAIKGALKTTNEAVST

LGNGVRVLATAVRELKEFVSKNLTSAINKNKCDIADLKMAVSFSQFNRRF

LNVVRQFSDNAGITPAISLDLMTDAELARAVSYMPTSAGQIKLMLENRAM

VRRKGFGILIGVYGSSVIYMVQLPIFGVIDTPCWIIKAAPSCSEKDGNYA

CLLREDQGWYCKNAGSTVYYPNKKDCETRGDHVFCDTAAGINVAEQSREC

NINISTTNYPCKVSTGRHPISMVALSPLGALVACYKGVSCSIGSNRVGII

KQLPKGCSYITNQDADTVTIDNTVYQLSKVEGEQHVIKGRPVSSSFDPIK

FPEDQFNVALDQVFESIENSQALVDQSNKILNSAEKGNTGFIIVIILIAV

LGLTMISVSIIIIIKKTRKPTGAPPELNGVTNGGFIPHS
```

Any of SEQ ID NOs: 1-7 can be modified as described herein to generate a recombinant HMPV F ectodomain trimer stabilized in the prefusion or postfusion conformation. The GenBank and Uniprot accession numbers listed above are incorporated by reference herein.

Further, as illustrated by SEQ ID NOs: 1-7, the HMPV F protein exhibits remarkable sequence conservation, with sequence identify of about 90% across HMPV subgroups. In view of the conservation and breadth of knowledge of HMPV F sequences, the person of ordinary skill in the art can easily identify corresponding HMPV F amino acid positions between different HMPV F strains and subgroups. The numbering of amino acid substitutions disclosed herein is made with reference to the F protein sequence of the CAN98-75 HMPV strain (SEQ ID NO: 7), unless context indicates otherwise.

Prefusion HMPV F

In some embodiments, the immunogen comprises a recombinant HMPV F ectodomain trimer comprising protomers comprising one or more amino acid substitutions or deletions that stabilize the HMPV F ectodomain trimer in the prefusion conformation. In some embodiments, the one or more amino acid substitutions comprise cysteine substitutions at HMPV F positions 84 and 249 (such as V84C/A249C substitutions) that form a non-natural inter-protomer disulfide bond. In some embodiments, the one or more amino acid substitutions comprise cysteine substitutions at HMPV F positions 140 and 147 (such as A140C/A147C substitutions) that form a non-natural intra-protomer disulfide bond. In some embodiments, the one or more amino acid substitutions comprise cysteine substitutions at HMPV F positions 84 and 249 (such as V84C/A249C substitutions) that form a non-natural inter-protomer disulfide bond, and cysteine substitutions at HMPV F positions 140 and 147 (such as A140C/A147C substitutions) that form a non-natural intra-protomer disulfide bond.

In some embodiments, the one or more amino acid substitutions in the protomers of the recombinant HMPV F ectodomain trimer comprise cysteine substitutions at one or more of HMPV F positions 26 and 439, 45 and 157, 51 and 166, 66 and 329, 80 and 224, 86 and 212, 103 and 366, 103 and 366, 106 and 321, 119 and 426, 120 and 426, 141 and 161, 154 and 396, 293 and 443, 365 and 455, and 454 and 458 to introduce a non-native disulfide bond.

In some embodiments, the one or more amino acid substitutions in the protomers of the recombinant HMPV F ectodomain trimer comprise proline substitutions at one or more of HMPV F positions 131, 143, 145, 163, and 459 for stabilization of the prefusion conformation. In some embodiments, the one or more amino acid substitutions in the protomers of the recombinant HMPV F ectodomain trimer comprise E131P, R163P, and A459P substitutions for stabilization of the prefusion conformation.

In some embodiments, the one or more amino acid substitutions in the protomers of the recombinant HMPV F ectodomain trimer comprise substitutions to alter amino acid charge, such as K324E, K324F, and K324Q substitutions.

In some embodiments, the one or more amino acid substitutions in the protomers of the recombinant HMPV F ectodomain trimer comprise cavity filling substitutions, such as a V191I substitution.

In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 154 and 396 (such as G154C and R396C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 154 and 396 (such as G154C and R396C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 154 and 396 (such as G154C and R396C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 454 and 458 (such as D454C and V458C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 454 and 458 (such as D454C and V458C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 454 and 458 (such as D454C and V458C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 141 and 161 (such as L141C and A161C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 141 and 161 (such as L141C and A161C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 141 and 161 (such as L141C and A161C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 26 and 439 (such as E26C and G439C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 26 and 439 (such as E26C and G439C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 26 and 439 (such as E26C and G439C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 45 and 157 (such as T45C and V157C substitutions) that form a non-natural disulfide bond. In some embodiments, the one or more amino acid substitutions comprise cysteine substitutions at HMPV F positions 84 and 249 (such as V84C/ A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 45 and 157 (such as T45C and V157C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 45 and 157 (such as T45C and V157C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 51 and 166 (such as E51C and K166C substitutions) that form a non-natural disulfide bond. In some embodiments, the one or more amino acid substitutions comprise cysteine substitutions at HMPV F positions 84 and 249 (such as V84C/ A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 51 and 166 (such as E51C and K166C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 51 and 166 (such as E51C and K166C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 80 and 224 (such as E80C and D224C substitutions) that form a non-natural disulfide bond. In some embodiments, the one or more amino acid substitutions comprise cysteine substitutions at HMPV F positions 84 and 249 (such as V84C/ A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 80 and 224 (such as E80C and D224C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 80 and 224 (such as E80C and D224C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 86 and 212 (such as A86C and G212C substitutions) that form a non-natural disulfide bond. In some embodiments, the one or more amino acid substitutions comprise cysteine substitutions at HMPV F positions 84 and 249 (such as V84C/ A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 86 and 212 (such as A86C and G212C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 86 and 212 (such as A86C and G212C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 103 and 366 (such as F103C and G366C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 103 and 366 (such as F103C and G366C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 103 and 366 (such as F103C and G366C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 103 and 366 (such as F103C and G366C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 103 and 366 (such as F103C and G366C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 103 and 366 (such as F103C and G366C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 106 and 321 (such as G106C and P321C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 106 and 321 (such as G106C and P321C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 106 and 321 (such as G106C and P321C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 365 and 455 (such as T365C and Q455C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 365 and 455 (such as T365C and Q455C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 365 and 455 (such as T365C and Q455C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146), for example substitution of HMPV F positions 89-112 (LAREEQIENPRQSRFVLGA-IALGV, SEQ ID NO: 243) to GSGGSG (SEQ ID NO: 146).

In some embodiments, the one or more amino acid substitutions in the protomers of the recombinant HMPV F ectodomain trimer stabilized in the prefusion conformation comprise cysteine substitutions at HMPV F positions 293 and 443 (such as S293C and S443C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, and cysteine substitutions at HMPV F positions 293 and 443 (such as S293C and S443C substitutions) that form a non-natural disulfide bond. In some embodiments, the one or more amino acid substitutions comprise cysteine substitutions at HMPV F positions 84 and 249 (such as V84C/A249C substitutions) that form a non-natural inter-protomer disulfide bond, cysteine substitutions at HMPV F positions 140 and 147 (such as A140C/A147C substitutions) that form a non-natural intra-protomer disulfide bond, cysteine substitutions at HMPV F positions 293 and 443 (such as S293C and S443C substitutions) that form a non-natural disulfide bond, and E131P, R163P, and A459P substitutions. In several such embodiments, the protomers of the recombinant HMPV F ectodomain trimer further comprise a mutation to inhibit protease cleavage at a $F_1/F_2$ protease cleavage site, such as substitution of HMPV F positions 89-112 to GSGGSG (SEQ ID NO: 146).

Non-limiting examples of amino acid sequences comprising protomers of the recombinant HMPV F ectodomain trimer stabilized in the prefusion conformation are provided herein as SEQ ID NOs: 8-28, 107-145, and 148-207. In some embodiments, the protomers of the recombinant HMPV F ectodomain trimer stabilized in the prefusion conformation comprise an amino acid sequence at least 90% (such as at least 95%, at least 98%, or at least 99%) identical to residues 1-466 of any one of SEQ ID NOs: 8-28 or 107-120, or residues 1-448 of any one of SEQ ID NOs: 121-123, 125-128, 130-132, 134-145, or 148-207, or residues 1-449 of any one of SEQ ID NOs: 124, 129, or 133, wherein the protomers comprise the one or more amino acid substitutions that stabilize the HMPV F ectodomain trimer in the prefusion conformation. In some embodiments, the protomers of the recombinant HMPV F ectodomain trimer stabilized in the prefusion conformation comprise an amino acid sequence set forth as residues 1-466 of any one of SEQ ID NOs: 8-28 or 107-120, or residues 1-448 of any one of SEQ ID NOs: 121-123, 125-128, 130-132, or 134-145, or 148-207, or residues 1-449 of any one of SEQ ID NOs: 124, 129, or 133.

Postfusion HMPV F

In some embodiments, the immunogen comprises a recombinant HMPV F ectodomain trimer comprising protomers comprising one or more amino acid substitutions or deletions that stabilize the HMPV F ectodomain trimer in the postfusion conformation. In some embodiments, the protomers of the recombinant HMPV F ectodomain trimer comprise a cysteine substitution at HMPV F position 63 (such as a G63C substitution) that forms a non-natural intra-protomer disulfide bond with the cysteine at HMPV F position 60. In some embodiments, the protomers of the recombinant HMPV F ectodomain trimer comprises a cysteine substitution at HMPV F position 188 (such as a K188C substitution) that form a non-natural inter-protomer disulfide bond with the cysteine at HMPV F position 180. In some embodiments, the protomers of the recombinant HMPV F ectodomain trimer comprise a cysteine substitution at HMPV F position 63 (such as a G63C substitution) that forms a non-natural intra-protomer disulfide bond with the cysteine at HMPV F position 60, and a cysteine substitution at HMPV F position 188 (such as a K188C substitution) that form a non-natural inter-protomer disulfide bond with the cysteine at HMPV F position 180. In some embodiments, the recombinant HMPV F ectodomain trimer stabilized in the postfusion conformation comprises protomers that further comprise cysteine substitutions at HMPV F positions 140, 147, 450, and/or 470. In some embodiments, the cysteine substitutions at HMPV F positions 140, 147, 450, and 470 are A140C, A147C, K450C, and S470C substitutions.

In some embodiments, the one or more amino acid substitutions in the protomers of the recombinant HMPV F ectodomain trimer stabilized in the postfusion conformation comprise cysteine substitutions at HMPV F positions 49 and 436 (such as T49C and V436C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 150 and 470 (such as T150C and S470C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 143 and 477 (such as K143C and S477C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 55 and 442 (such as V55C and V442C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 197 and 439 (such as N197C and G439C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 314 and 421 (such as A314C and D421C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 214 and 257 (such as T214C and G257C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 211 and 252 (such as A211C and R252C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 145 and 474 (such as N145C and V474C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 147 and 473 (such as A147C and L473C substitutions) that form a non-natural disulfide bond.

In some embodiments, the one or more amino acid substitutions in the protomers of the recombinant HMPV F ectodomain trimer stabilized in the postfusion conformation comprise cysteine substitutions at HMPV F positions 388 and 315 (such as V388C and G315C substitutions) that form a non-natural disulfide bond.

In some embodiments, the one or more amino acid substitutions in the protomers of the recombinant HMPV F ectodomain trimer stabilized in the postfusion conformation comprise cysteine substitutions at one or more of HMPV F positions 49 and 436, 150 and 470, 143 and 477, 55 and 442, 197 and 439, 314 and 421, 214 and 257, 211 and 252, 145 and 474, 147 and 473, or 388 and 315 to introduce a non-native disulfide bond.

In some embodiments, the one or more amino acid substitutions in the protomers of the recombinant HMPV F ectodomain trimer stabilized in the postfusion conformation comprise a deletion of residues 103-180, 115-180, 127-180, 139-180, 151-180, 163-180, 103-173, 103-162, 103-150, 103-148, 103-126, or 103-114. In some embodiments, the one or more amino acid substitutions in the protomers of the recombinant HMPV F ectodomain trimer stabilized in the postfusion conformation comprise a deletion of residue 163-180; any of the postfusion HMPV F immunogens provided herein can be modified to include the 163-180 deletion. Non-limiting examples of sequences including these mutations are provided as SEQ ID NOs: 231-242.

In any of the embodiments of the recombinant HMPV F ectodomain trimer stabilized in the postfusion conformation provided herein, the one or more amino acid substitutions in the protomers can comprise G63C, K188C, and A140C/A147C substitutions. In any of the embodiments of the recombinant HMPV F ectodomain trimer stabilized in the postfusion conformation provided herein, the one or more amino acid substitutions in the protomers can comprise G63C, K188C, and A140C/A147C substitutions, and substitution of HMPV positions 97-102 to GGGGGG (SEQ ID NO: 147).

Non-limiting examples of amino acid sequences of protomers of the recombinant HMPV F ectodomain trimer stabilized in the postfusion conformation are provided herein as SEQ ID NOs: 211-230 and residues 1-466 of SEQ ID NOs: 29-49. In some embodiments, the protomers of the recombinant HMPV F ectodomain trimer stabilized in the prefusion conformation comprise an amino acid sequence at least 90% (such as at least 95%, at least 98%, or at least 99%) identical to SEQ ID NOs: 211-230 or residues 1-466 of SEQ ID NOs: 29-49, wherein the protomers comprise the one or more amino acid substitutions that stabilize the HMPV F ectodomain trimer in the prefusion conformation. In some embodiments, the protomers of the recombinant HMPV F ectodomain trimer stabilized in the prefusion conformation comprise an amino acid sequence set forth as SEQ ID NOs: 211-230 or residues 1-466 of any one of SEQ ID NOs: 29-49.

Additional Description of Prefusion and Postfusion HMPV F

In several embodiments, the recombinant HMPV F ectodomain trimer is a soluble protein complex, for example, for use as a recombinant subunit vaccine. In several such embodiments, the C-terminal residue of the ectodomains of the protomers in the recombinant HMPV F ectodomain trimer can be linked to a trimerization domain to promote trimerization of the protomers, and to stabilize the membrane proximal aspect of the protomers in a trimeric configuration. Non-limiting examples of exogenous multimerization domains that promote stable trimers of soluble recombinant proteins include: the GCN4 leucine zipper (Harbury et al. 1993 *Science* 262:1401-1407), the trimerization motif from the lung surfactant protein (Hoppe et al. 1994 *FEBS Lett* 344:191-195), collagen (McAlinden et al. 2003 *J Biol Chem* 278:42200-42207), and the phage T4 fibritin (Miroshnikov et al. 1998 *Protein Eng* 11:329-414), any of which can be linked to a recombinant HMPV F ectodomain described herein (e.g., by linkage to the C-terminus of F1 ectodomain) to promote trimerization of the recombinant HMPV F ectodomain.

In some examples, a C-terminal residue of the F1 ectodomain can be linked to a T4 fibritin domain. In specific examples, the T4 fibritin domain can include the amino acid sequence GYIPEAPRDGQAYVRKDGEWVLLSTF (SEQ ID NO: 96), which adopts a β-propeller conformation, and can fold and trimerize in an autonomous way (Tao et al. 1997 Structure 5:789-798).

Optionally, the heterologous trimerization is connected to the recombinant HMPV F ectodomain via a peptide linker, such as an amino acid linker. Non-limiting examples of peptide linkers that can be used include glycine, serine, and glycine-serine linkers.

Non-limiting examples of HMPV F ectodomain sequences including the one or more substitutions for stabilization in the prefusion conformation and linked to a T4 fibritin trimerization domain are provided as SEQ ID NOs: 8-28, 107-145, and 148-179. In some embodiments, the recombinant HMPV F ectodomain trimer linked to the T4 fibritin trimerization domain comprises protomers comprising a sequence at least 90% (such as at least 95%, at least 98%, or at least 99%) identical to any one of SEQ ID NOs: 8-28, 107-145, or 148-179 and comprises the one or more amino acid substitutions that stabilize the F ectodomain trimer in the prefusion conformation. In some embodiments, the recombinant HMPV F ectodomain trimer linked to the T4 fibritin trimerization domain comprises protomers comprising a sequence set forth as any one of SEQ ID NOs: 8-28, 107-145, and 148-179.

Non-limiting examples of HMPV F ectodomain sequences including the one or more substitutions for stabilization in the postfusion conformation and linked to a T4 fibritin trimerization domain are provided as SEQ ID NOs: 29-50. In some embodiments, the recombinant HMPV F ectodomain trimer linked to the T4 fibritin trimerization domain comprises protomers comprising a sequence at least 90% (such as at least 95%, at least 98%, or at least 99%) identical to any one of SEQ ID NOs: 29-50 and comprises the one or more amino acid substitutions that stabilize the F ectodomain trimer in the postfusion conformation. In some embodiments, the recombinant HMPV F ectodomain trimer linked to the T4 fibritin trimerization domain comprises protomers comprising a sequence set forth as any one of SEQ ID NOs: 29-50.

In some embodiments, the HMPV F ectodomain trimer is membrane anchored, for example, for embodiments where the HMPV F ectodomain trimer is expressed on an attenuated viral vaccine, or a virus like particle, or by recombinant nucleic acid. In such embodiments, the protomers in the trimer typically each comprise a C-terminal linkage to a transmembrane domain, such as the transmembrane domain (and optionally the cytosolic tail) of HMPV F protein. In some embodiments, one or more peptide linkers (such as a gly-ser linker, for example, a 10 amino acid glycine-serine peptide linker can be used to link the recombinant HMPV F ectodomain protomer to the transmembrane domain. The protomers linked to the transmembrane domain can include any of the stabilizing mutations provided herein (or combinations thereof) as long as the recombinant HMPV F ectodomain trimer formed from the protomers linked to the transmembrane domain retains the desired properties (e.g., the HMPV F prefusionor postfusion conformation).

Non-limiting examples of protomer sequences of HMPV F protein (including the ectodomain and TM and CT domains) including the one or more amino acid substitutions for stabilization in the prefusion conformation are provided as SEQ ID NOs: 50-70 and 180-207. In some embodiments, the recombinant HMPV F ectodomain trimer linked to the transmembrane and cytoplasmic tail comprises protomers comprising a sequence at least 90% (such as at least 95%, at least 98%, or at least 99%) identical to any one of SEQ ID NOs: 50-70 or 180-207 and comprises the one or more amino acid substitutions that stabilize the F ectodomain trimer in the prefusion conformation. In some embodiments, the recombinant HMPV F ectodomain trimer linked to the transmembrane domain and cytoplasmic tail comprises protomers comprising a sequence set forth as any one of SEQ ID NOs: 50-70 or 180-207.

Non-limiting examples of protomer sequences of HMPV F protein (including the ectodomain and TM and CT domains) including the one or more amino acid substitutions for stabilization in the postfusion conformation are provided as SEQ ID NOs: 71-91. In some embodiments, the recombinant HMPV F ectodomain trimer linked to the transmembrane and cytoplasmic tail comprises protomers comprising a sequence at least 90% (such as at least 95%, at least 98%, or at least 99%) identical to any one of SEQ ID NOs: 71-91 and comprises the one or more amino acid substitutions that stabilize the F ectodomain trimer in the postfusion conformation. In some embodiments, the recombinant HMPV F ectodomain trimer linked to the transmembrane domain and cytoplasmic tail comprises protomers comprising a sequence set forth as any one of SEQ ID NOs: 71-91.

In several embodiments, the N-terminal position of the recombinant $F_2$ polypeptide in the protomer can be one of HMPV F positions 8-30 (such as position 20), and the C-terminal position of the $F_1$ ectodomain can be from the stem region of the ectodomain, such as one of HMPV F positions 450-490 (such as position 466).

Native HMPV F sequences include a protease cleavage site (e.g., RQSR, SEQ ID NO: 97) leading to proteolytic cleavage between positions 102 and 103 (with reference to SEQ ID NO: 7), that separates $F_2$ and $F_1$. In several embodiments, an HMPV F protein is provided that includes an enhanced cleavage site (e.g., a canonical furin cleavage site sequence of R-X-(R/K)-R) leading to proteolytic between $F_2$ and $F_1$ proteins. The enhanced cleavage cite can include, for example, substitution of six arginine resides for the four residues of the native cleavage site (e.g., RQSR (SEQ ID NO: 98) to RRRRRR (SEQ ID NO: 99). Alternative cleavage sites include, but are not limited to, RRRR (SEQ ID NO: 100), RAKR (SEQ ID NO: 101), or RKAR (SEQ ID NO: 102) sequences.

In some embodiments, the protomers of the HMPV F ectodomain trimer further comprise a mutation to inhibit protease cleavage at a $F_1/F_2$ protease cleavage site to generate a "single chain" recombinant F protein. In some embodiments, the protomers comprise one or more amino acid substitutions to remove the $F_1/F_2$ protease cleavage site and the $F_2$ polypeptide and $F_1$ ectodomain are linked by a heterologous peptide linker, or are directly linked. Examples of peptide linkers that can be used include glycine, serine, and glycine-serine linkers, such as a glycine, serine, or glycine-serine linker of up to 10 amino acids in length, for example, 4, 5, 6, 7, or 8 amino acids in length. In non-limiting examples, the heterologous peptide linker joins HMPV F positions 88 and 113, 96 and 103, 97 and 103, 98 and 103, 100 and 103, or 101 and 103. In some embodiments, the F1/F2 protease cleavage site is mutated by substitution of HMPV F positions 99-102 to GGGG, substitution of HMPV positions 97-102 to GGGGGG (SEQ ID NO: 147), substitution of HMPV F positions 89-112 to GGGGGG (SEQ ID NO: 147), or substitution of HMPV F positions 89-112 to GSGGSG (SEQ ID NO: 146) to generate a single-chain HMPV F protein. Any of the stabilizing mutations (or combinations thereof) disclosed herein can be included in the single chain HMPV F ectodomain protomers as long as the HMPV F ectodomain trimer composed of such protomers retains the desired properties (e.g., the prefusion or postfusion conformation).

In additional embodiments, the C-terminus of the protomers of the HMPV F ectodomain trimer (or a C-terminal residue of a trimerization domain fused to HMPV F ectodomain trimer) is linked to a moiety of an isopeptide bond conjugation system, for conjugation to an appropriate support, or nanoparticle structure. For example, the C-terminus the protomers of the HMPV F ectodomain trimer (or a C-terminal residue of a trimerization domain fused to HMPV F ectodomain trimer) is linked to the Tag of the SpyTag:SpyCatcher system (Brune, K. D. et al. Plug-and-Display: decoration of Virus-Like Particles via isopeptide bonds for modular immunization. Sci Rep 6, 19234, 2016) to display antigens on nanoparticle surface. The SpyTag:Spy-Catcher system is highly specific and stable with an isopeptide bond and has been used for conjugation of antigens on nanoparticle surfaces (See Zakeri, B. et al. "Peptide tag forming a rapid covalent bond to a protein, through engineering a bacterial adhesin." Proc Natl Acad Sci USA 109, E690-697, (2012); Brune, K. D. et al. Plug-and-Display: decoration of Virus-Like Particles via isopeptide bonds for modular immunization. Sci Rep 6, 19234, (2016)). A non-limiting example of a Tag sequence for use with this system is provided as VPTIVMVDAYKRYK (SEQ ID NO: 208). Non-limiting examples of protomers of the HMPV F ectodomain trimer stabilized in the prefusion conformation and fused to a T4 Fibritin trimerization domain and SpyTag are provided as SEQ ID NOs: 209 and 210.

Additional Description of the Disclosed Embodiments

The protomers in the recombinant HMPV F ectodomain trimer can comprise modifications of the native HMPV F sequence in addition to those noted above, such as amino acid substitutions, deletions or insertions, glycosylation and/or covalent linkage to unrelated proteins (e.g., a protein tag), as long as the recombinant HMPV F ectodomain trimer remains stabilized in the desired conformation (e.g., prefusion or postfusion conformation) and retains immunogenicity. These variations in sequence can be naturally occurring variations or they can be engineered through the use of genetic engineering technique known to those skilled in the art. Examples of such techniques are found in see, e.g., Sambrook et al. (Molecular Cloning: A Laboratory Manual, $4^{th}$ ed., Cold Spring Harbor, New York, 2012) and Ausubel et al. (In Current Protocols in Molecular Biology, John Wiley & Sons, New York, through supplement 104, 2013, both of which are incorporated herein by reference in their entirety.

In some embodiments, the protomers in the recombinant HMPV F ectodomain trimer comprise one or more amino acid substitutions compared to a corresponding native HMPV F sequence. For example, in some embodiments, the $F_2$ polypeptide, $F_1$ ectodomain, or both, can include up to 20 (such as up to 1, 2, 3, 4, 5, 6, 7, 8, 9, 10, 11, 12, 13, 14, 15, 16, 17, 18, or 19) amino acid substitutions (such as conservative amino acid substitutions) compared to a native HMPV F sequence. The simplest modifications involve the substitution of one or more amino acids for amino acids having similar biochemical properties, such as conservative amino acid substitutions. Such substitutions are likely to have minimal impact on the activity of the resultant protein.

In some embodiments, protomers in the recombinant HMPV F ectodomain trimer can be joined at either end to other unrelated sequences (for example non-MPV F sequences, non-viral envelope, or non-viral protein sequences)

In several embodiments, the recombinant HMPV F ectodomain trimer is soluble in aqueous solution. In some embodiments, the recombinant HMPV F ectodomain trimer dissolves to a concentration of at least 0.5 mg/ml (such as at least 1.0 mg/ml, 1.5 mg/ml, 2.0 mg/ml, 3.0 mg/ml, 4.0 mg/ml or at least 5.0 mg/ml) in aqueous solution (such as phosphate buffered saline (pH 7.4) or 350 mM NaCl (pH 7.0)) at room temperature (e.g., 20-22 degrees Celsius) and remain dissolved for at least 12 hours (such as at least 24 hours, at least 48 hours, at least one week, at least two weeks, at least one month, or more time). In one embodiment, the phosphate buffered saline includes NaCl (137 mM), KCl (2.7 mM), Na$_2$HPO$_4$ (10 mM), KH$_2$PO$_4$ (1.8 mM) at pH 7.4. In some embodiments, the phosphate buffered saline further includes CaCl$_2$ (1 mM) and MgCl$_2$ (0.5 mM). The person of skill in the art is familiar with methods of determining if a protein remains in solution over time. For example, the concentration of the protein dissolved in an aqueous solution can be tested over time using standard methods.

In some embodiments, the recombinant HMPV F ectodomain trimer can be provided as a homogenous population of soluble trimers that does not include detectable HMPV F ectodomain trimer in a postfusion conformation. The conformation of the HMPV F ectodomain trimer can be detected, for example, by negative stain electron microscopy and/or specific binding by appropriate prefusion or postfusion specific antibody. In some embodiments, at least about 95% of the recombinant HMPV F ectodomain trimer (such as at least about 95%, 96%, 97%, 98%, 99% or 99.9% of the HMPV F proteins) in the homogeneous population are stabilized in the prefusion conformation.

In some embodiments, the recombinant HMPV F ectodomain trimer retains specific binding for a prefusion specific antibody following incubation at 50° C. for one hour in phosphate buffered saline. In some embodiments, the recombinant HMPV F ectodomain trimer retains specific binding for a prefusion specific antibody following incubation at 4° C. for six months in phosphate buffered saline.

In certain embodiments, an immunogen provided herein may be further modified to contain additional nonproteinaceous moieties that are known in the art and readily available. The moieties suitable for derivatization of the immunogen include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, prolypropylene oxide/ethylene oxide copolymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the immunogen to be improved or altered, whether the immunogen derivative will be used in a therapy under defined conditions, etc.

Some of the sequences including recombinant HMPV F ectodomain provided herein include the sequence of protease cleavage sites (such as thrombin sites), protein tags (such as a His tag, a Strep Tag II, a Avi tag, etc.), and signal peptides; such sequences can be removed from an isolated immunogen including a recombinant HMPV F ectodomain trimer for therapeutic use.

Exemplary Sequences

Prefusion, Foldon Domain Sequences

Substitutions to Introduce a Disulfide Bond for Prefusion Stabilization

```
NL/1/00 A140C/A147C Fd
                                                      (SEQ ID NO: 8)
KESYLEESCSTITEGYLSVLRTGWYTNVFTLEVGDVENLTCADGPSLIKTELDLTKSALRELRTVSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN97-83 A140C/A147C Fd
                                                      (SEQ ID NO: 9)
KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF
```

-continued

NL/17/00 A140C/A147C Fd (SEQ ID NO: 10)

KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NCL174 A140C/A147C Fd (SEQ ID NO: 11)

KESYLEESCSTITEGYLSVLRTGWYTNVFTLEVGDVENLTCADGPSLIKTELDLTKSALRELKPVSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEGGYIPEAPRDGQAY

VRKDGEWVLLSTF

NL/1/99 A140C/A147C Fd (SEQ ID NO: 12)

KESYLEESCSTITEGYLSVLRTGWYTNVFTLEVGDVENLTCTDGPSLIKTELDLTKSALRELKTVSADQLAREEQIENPR

QSRFVLGAIALGVATAAAVTAGIAIAKTIRLESEVNAIKGCLKQTNECVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NDL00-1 A140C/A147C Fd (SEQ ID NO: 13)

KESYLEESCSTITEGYLSVLRTGWYTNVFTLEVGDVENLTCADGPSLIKTELDLTKSALRELRTVSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN98-75 A140C/A147C Fd (SEQ ID NO: 14)

KESYLEESCSTITEGYLSVLRTGWYTNVFTLEVGDVENLTCTDGPSLIKTELDLTKSALRELKTVSADQLAREEQIENPR

QSRFVLGAIALGVATAAAVTAGIAIAKTIRLESEVNAIKGCLKTTNECVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NL/1/00 V84C/A249C Fd (SEQ ID NO: 15)

KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN97-83 V84C/A249C Fd (SEQ ID NO: 16)

KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NL/17/00 V84C/A249C Fd (SEQ ID NO: 17)

KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NCL174 V84C/A249C Fd (SEQ ID NO: 18)

KESYLEESCSTITEGYLSVLRTGWYTNVFTLEVGDVENLTCADGPSLIKTELDLTKSALRELKPCSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRCMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEGGYIPEAPRDGQAY

VRKDGEWVLLSTF

NL/1/99 V84C/A249C Fd (SEQ ID NO: 19)

KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NDL00-1 V84C/A249C Fd (SEQ ID NO: 20)

KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN98-75 V84C/A249C Fd (SEQ ID NO: 21)

KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NL/1/00 V84C/A249C, A140C/A147C Fd (SEQ ID NO: 22)

KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN97-83 V84C/A249C, A140C/A147C Fd (SEQ ID NO: 23)

KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NL/17/00 V84C/A249C, A140C/A147C Fd (SEQ ID NO: 24)

KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

-continued

NCL174 V84C/A249C, A140C/A147C Fd (SEQ ID NO: 25)

KESYLEESCSTITEGYLSVLRTGWYTNVFTLEVGDVENLTCADGPSLIKTELDLTKSALRELKPCSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRCMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEGGYIPEAPRDGQAY

VRKDGEWVLLSTF

NL/1/99 V84C/A249C, A140C/A147C Fd (SEQ ID NO: 26)

KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGCLKQTNECVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NDL00-1 V84C/A249C, A140C/A147C Fd (SEQ ID NO: 27)

KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN98-75 V84C/A249C, A140C/A147C Fd (SEQ ID NO: 28)

KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGCLKTTNECVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

HMPV F V84C/A249C, A140C/A147C, G154C/R396C, NPRQSR97-
102GGGGGG (SEQ ID NO: 107)

KESYLEESCSTITEGYLSVLRTGWYTNVFTLEVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNCVRVLATAVRELKEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNCVGIIKQLPKGCSYITNQDADTVT

IDNTVYQLSKVEGEQHVIKGRPVSSSFDPIKFPEDQFNVALDQVFESIENSQALVDQSNKILNSAESAIGGYIPEAPRDG

QAYVRKDGEWVLLSTF

-continued

HMPV F V84C/A249C, A140C/A147C, GV154Cg/R396C, NPRQSR97-
102GGGGGG (SEQ ID NO: 108)
KESYLEESCSTITEGYLSVLRTGWYTNVFTLEVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNCgRVLATAVRELKEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNCVGIIKQLPKGCSYITNQDADTVT

IDNTVYQLSKVEGEQHVIKGRPVSSSFDPIKFPEDQFNVALDQVFESIENSQALVDQSNKILNSAESAIGGYIPEAPRDG

QAYVRKDGEWVLLSTF

HMPV F V84C/A249C, A140C/A147C, G154CG/R396C, NPRQSR97-
102GGGGGG (SEQ ID NO: 109)
KESYLEESCSTITEGYLSVLRTGWYTNVFTLEVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNCgVRVLATAVRELKEFVSKNLTSAIN

KNKCDIPDLKMAVSFSQFNRRFLNVVRQFSDNAGITPAISLDLMTDAELARAVSYMPTSAGQIKLMLENRcMVRRKGFGI

LIGVYGSSVIYMVQLPIFGVIDTPCWIIKAAPSCSEKDGNYACLLREDQGWYCKNAGSTVYYPNDKDCETRGDHVFCDTA

AGINVAEQSRECNINISTTNYPCKVSTGRHPISMVALSPLGALVACYKGVSCSIGSNCVGIIKQLPKGCSYITNQDADTV

TIDNTVYQLSKVEGEQHVIKGRPVSSSFDPIKFPEDQFNVALDQVFESIENSQALVDQSNKILNSAESAIGGYIPEAPRD

GQAYVRKDGEWVLLSTF

HMPV F V84C/A249C, A140C/A147C, D454C/V458C, NPRQSR97-
102GGGGGG (SEQ ID NO: 110)
KESYLEESCSTITEGYLSVLRTGWYTNVFTLEVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPECQFNCALDQVFESIENSQALVDQSNKILNSAESAIGGYIPEAPRDG

QAYVRKDGEWVLLSTF

HMPV F V84C/A249C, A140C/A147C, L141C/A161C, NPRQSR97-
102GGGGGG (SEQ ID NO: 111)
KESYLEESCSTITEGYLSVLRTGWYTNVFTLEVGDVENLTCTDGPSLIKTELDLTKSALRELKTcSADQLAREEQIEGGG

GGGFVLGAIALGVATAAAVTAGIAIAKTIRLESEVNAIKGACKTTNEAVSTLGNGVRVLATCVRELKEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAESAIGGYIPEAPRDG

QAYVRKDGEWVLLSTF

HMPV F V84C/A249C, A140C/A147C, E26C/G439C, NPRQSR97-
102GGGGGG (SEQ ID NO: 112)
KESYLECSCSTITEGYLSVLRTGWYTNVFTLEVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

-continued

IDNTVYQLSKVEGEQHVIKCRPVSSSFDPIKFPEdQFNvALDQVFESIENSQALVDQSNKILNSAESAIGGYIPEAPRDG

QAYVRKDGEWVLLSTF

HMPV F V84C/A249C, A140C/A147C, T45C/V157C, NPRQSR97-
102GGGGGG (SEQ ID NO: 113)

KESYLEESCSTITEGYLSVLRTGWYcNVFTLEVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNGc**RVLATAVRELKEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEdQFNvALDQVFESIENSQALVDQSNKILNSAESAIGGYIPEAPRDG

QAYVRKDGEWVLLSTF

HMPV F V84C/A249C, A140C/A147C, E51C/K166C, NPRQSR97-
102GGGGGG (SEQ ID NO: 114)

KESYLEESCSTITEGYLSVLRTGWYTNVFTLCVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNGVRVLATAVRELcEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEdQFNvALDQVFESIENSQALVDQSNKILNSAESAIGGYIPEAPRDG

QAYVRKDGEWVLLSTF

HMPV F V84C/A249C, A140C/A147C, E80C/D224C, NPRQSR97-
102GGGGGG (SEQ ID NO: 115)

KESYLEESCSTITEGYLSVLRTGWYTNVFTLEVGDVENLTCTDGPSLIKTELDLTKSALRCLKTcSADQLAREEQIEGGG

GGGFVLGAIALGVATAAAVTAGIAIAKTIRLESEVNAIKGCLKTTNECVSTLGNGVRVLATAVRELKkEFVSKNLTSAINK

NKCDIPDLKMAVSFSQFNRRFLNVVRQFSDNAGITPAISLDLMTCAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEdQFNvALDQVFESIENSQALVDQSNKILNSAESAIGGYIPEAPRDG

QAYVRKDGEWVLLSTF

HMPV F V84C/A249C, A140C/A147C, A86C/G212C, NPRQSR97-
102GGGGGG (SEQ ID NO: 116)

KESYLEESCSTITEGYLSVLRTGWYTNVFTLEVGDVENLTCTDGPSLIKTELDLTKSALRELKTcSCDQLAREEQIEGGG

GGGFVLGAIALGVATAAAVTAGIAIAKTIRLESEVNAIKGCLKTTNECVSTLGNGVRVLATAVRELKkEFVSKNLTSAINK

NKCDIPDLKMAVSFSQFNRRFLNVVRQFSDNACITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEdQFNvALDQVFESIENSQALVDQSNKILNSAESAIGGYIPEAPRDG

QAYVRKDGEWVLLSTF

HMPV F 84C/A249C, A140C/A147C, F103C/G366C, NPRQSR97-
102GGGGGG (SEQ ID NO: 117)

KESYLEESCSTITEGYLSVLRTGWYTNVFTLEVGDVENLTCTDGPSLIKTELDLTKSALRELKTcSADQLAREEQIEGGG

GGGCVLGAIALGVATAAAVTAGIAIAKTIRLESEVNAIKGCLKTTNECVSTLGNGVRVLATAVRELKkEFVSKNLTSAINK

NKCDIPDLKMAVSFSQFNRRFLNVVRQFSDNAGITPAISLDLMTDAELARAVSYMPTSAGQIKLMLENRcMVRRKGFGIL

-continued

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTCRHPISMVALSPLGALVACYKGVSCSIGSNRVGIIKQLPKGCSYITNQDADTVT

IDNTVYQLSKVEGEQHVIKGRPVSSSFDPIKFPEdQFNvALDQVFESIENSQALVDQSNKILNSAESAIGGYIPEAPRDG

QAYVRKDGEWVLLSTF

HMPV F V84C/A249C, A140C/A147C, G106C/P321C, NPRQSR97-
102GGGGGG (SEQ ID NO: 118)
KESYLEESCSTITEGYLSVLRTGWYTNVFTLEVGDVENLTCTDGPSLIKTELDLTKSALRELKTcSADQLAREEQIEGGG

GGGFVLCAIALGVATAAAVTAGIAIAKTIRLESEVNAIKGCLKTTNECVSTLGNGVRVLATAVRELkEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYCNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEdQFNvALDQVFESIENSQALVDQSNKILNSAESAIGGYIPEAPRDG

QAYVRKDGEWVLLSTF

HMPV F V84C/A249C, A140C/A147C, T365C/Q455C, NPRQSR97-
102GGGGGG (SEQ ID NO: 119)
KESYLEESCSTITEGYLSVLRTGWYTNVFTLEVGDVENLTCTDGPSLIKTELDLTKSALRELKTcSADQLAREEQIEGGG

GGGFVLGAIALGVATAAAVTAGIAIAKTIRLESEVNAIKGCLKTTNECVSTLGNGVRVLATAVRELkEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSCGRHPISMVALSPLGALVACYKGVSCSIGSNRVGIIKQLPKGCSYITNQDADTVT

IDNTVYQLSKVEGEQHVIKGRPVSSSFDPIKFPEdcFNvALDQVFESIENSQALVDQSNKILNSAESAIGGYIPEAPRDG

QAYVRKDGEWVLLSTF

HMPV F V84C/A249C, A140C/A147C, S293C/S443C, NPRQSR97-
102GGGGGG (SEQ ID NO: 120)
KESYLEESCSTITEGYLSVLRTGWYTNVFTLEVGDVENLTCTDGPSLIKTELDLTKSALRELKTcSADQLAREEQIE<u>GGG</u>

<u>GGG</u>FVLGAIALGVATAAAVTAGIAIAKTIRLESEVNAIKGCLKTTNECVSTLGNGVRVLATAVRELKEFVSKNLTSAINK

NKCDIPDLKMAVSFSQFNRRFLNVVRQFSDNAGITPAISLDLMTDAELARAVSYMPTSAGQIKLMLENRcMVRRKGFGIL

IGVYGSSVIYMVQLPIFGVIDTPCWIIKAAP<u>SCC</u>EKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVCSSFDPIKFPEdQFNvALDQVFESIENSQALVDQSNKILNSAESAIGGYIPEAPRDG

QAYVRKDGEWVLLSTF

HMPV F V84C/A249C, A140C/A147C, A120C-Q426C, 89-112GSGGSG (SEQ ID NO: 121)
KESYLEESCSTITEGYLSVLRTGWYTNVFTLEVGDVENLTCTDGPSLIKTELDLTKSALRELKTcSA<u>DQ</u>gsggsgATAAA

VTCGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYCLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, T119C-Q426C, 89-112GSGGSG (SEQ ID NO: 122)
KESYLEESCSTITEGYLSVLRTGWYTNVFTLEVGDVENLTCTDGPSLIKTELDLTKSALRELKTcSA<u>DQ</u>gsggsgATAAA

VCAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

-continued

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYCLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, G154C-R396C, 89-112GSGGSG (SEQ ID NO: 123)

KESYLEESCSTITEGYLSVLRTGWYTNVFTLEVGDVENLTCTDGPSLIKTELDLTKSALRELKTcSA<u>DQ</u>gsggsgATAAA

VTAGIAIAKTIRLESEVNAIKGCLKTTNECVSTLGNcVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNcVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, G154Cg-R396C, 89-112GSGGSG (SEQ ID NO: 124)

KESYLEESCSTITEGYLSVLRTGWYTNVFTLEVGDVENLTCTDGPSLIKTELDLTKSALRELKTcSA<u>DQ</u>gsggsgATAAA

VTAGIAIAKTIRLESEVNAIKGCLKTTNECVSTLGNcgVRVLATAVRELKEFVSKNLTSAINKNKCDIPDLKMAVSFSQF

NRRFLNVVRQFSDNAGITPAISLDLMTDAELARAVSYMPTSAGQIKLMLENRcMVRRKGFGILIGVYGSSVIYMVQLPIF

GVIDTPCWIIKAAPSCSEKDGNYACLLREDQGWYCKNAGSTVYYPNDKDCETRGDHVFCDTAAGINVAEQSRECNINIST

TNYPCKVSTGRHPISMVALSPLGALVACYKGVSCSIGSNcVGIIKQLPKGCSYITNQDADTVTIDNTVYQLSKVEGEQHV

IKGRPVSSSFDPIKFPEDQFNVALDQVFESIENSQALVDQSNKILNSAE SAIGGYIPEAPRDGQAYVRKDGEWVLLSTF

HMPV F V84C/A249C, A140C/A147C, D454C-V458C, 89-112GSGGSG (SEQ ID NO: 125)

KESYLEESCSTITEGYLSVLRTGWYTNVFTLEVGDVENLTCTDGPSLIKTELDLTKSALRELKTcSADQGSGGSGATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPECQFNCALDQVFESIENSQALVDQSNKILNSAE  SAIGGYIPEAPRDGQAYVRKDGEWVLLSTF

HMPV F V84C/A249C, A140C/A147C, L141C-A161C, 89-112GSGGSG (SEQ ID NO: 126)

KESYLEESCSTITEGYLSVLRTGWYTNVFTLEVGDVENLTCTDGPSLIKTELDLTKSALRELKTcSADQGSGGSGATAAA

VTAGIAIAKTIRLESEVNAIKGACKTTNEAVSTLGNGVRVLAT<u>C</u>VRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, E26C-G439C, 89-112GSGGSG (SEQ ID NO: 127)

KESYLEcSCSTITEGYLSVLRTGWYTNVFTLEVGDVENLTCTDGPSLIKTELDLTKSALRELKTcSA<u>DQ</u>gsggsgATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KcRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, L375C, 89-112GSCGSG (SEQ ID NO: 128)

KESYLEESCSTITEGYLSVLRTGWYTNVFTLEVGDVENLTCTDGPSLIKTELDLTKSALRELKTcSA<u>DQ</u>gscgsgATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVAcSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, L375C, 89-112GSGCGSG (SEQ ID NO: 129)

KESYLEESCSTITEGYLSVLRTGWYTNVFTLEVGDVENLTCTDGPSLIKTELDLTKSALRELKTcSAD<u>Qgsgcgsg</u>ATAA

AVTAGIAIAKTIRLESEVNAIKGCLKTTNECVSTLGNGVRVLATAVRELKEFVSKNLTSAINKNKCDIPDLKMAVSFSQF

NRRFLNVVRQFSDNAGITPAISLDLMTDAELARAVSYMPTSAGQIKLMLENRcMVRRKGFGILIGVYGSSVIYMVQLPIF

GVIDTPCWIIKAAPSCSEKDGNYACLLREDQGWYCKNAGSTVYYPNDKDCETRGDHVFCDTAAGINVAEQSRECNINIST

TNYPCKVSTGRHPISMVAcSPLGALVACYKGVSCSIGSNRVGIIKQLPKGCSYITNQDADTVTIDNTVYQLSKVEGEQHV

IKGRPVSSSFDPIKFPEDQFNVALDQVFESIENSQALVDQSNKILNSAESAIGGYIPEAPRDGQAYVRKDGEWVLLSTF

HMPV F V84C/A249C, A140C/A147C, T365C-Q455C, 89-112GSGGSG (SEQ ID NO: 130)

KESYLEESCSTITEGYLSVLRTGWYTNVFTLEVGDVENLTCTDGPSLIKTELDLTKSALRELKTcSAD<u>Qgsggsg</u>ATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVScGRHPISMVALSPLGALVACYKGVSCSIGSNRVGIIKQLPKGCSYITNQDADTVTIDNTVYQLSKVEGEQHVI

KGRPVSSSFDPIKFPEDcFNVALDQVFESIENSQALVDQSNKILNSAE  SAIGGYIPEAPRDGQAYVRKDGEWVLLSTF

HMPV F V84C/A249C, A140C/A147C, S293C-S443C, 89-112GSGGSG (SEQ ID NO: 131)

KESYLEESCSTITEGYLSVLRTGWYTNVFTLEVGDVENLTCTDGPSLIKTELDLTKSALRELKTcSAD<u>Qgsggsg</u>ATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPScCEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVcSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, D66C-R329C, 89-112GSGGSG (SEQ ID NO: 132)

KESYLEESCSTITEGYLSVLRTGWYTNVFTLEVGDVENLTCTDGPSLIKTELDLTKSALRELKTcSAc<u>Qgsggsg</u>ATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETcGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, D66DC-R329C, 89-112GSGGSG (SEQ ID NO: 133)

KESYLEESCSTITEGYLSVLRTGWYTNVFTLEVGDVENLTCTDGPSLIKTELDLTKSALRELKTcSADc<u>Qgsggsg</u>ATAA

AVTAGIAIAKTIRLESEVNAIKGCLKTTNECVSTLGNGVRVLATAVRELKEFVSKNLTSAINKNKCDIPDLKMAVSFSQF

NRRFLNVVRQFSDNAGITPAISLDLMTDAELARAVSYMPTSAGQIKLMLENRcMVRRKGFGILIGVYGSSVIYMVQLPIF

GVIDTPCWIIKAAPSCSEKDGNYACLLREDQGWYCKNAGSTVYYPNDKDCETcGDHVFCDTAAGINVAEQSRECNINIST

TNYPCKVSTGRHPISMVALSPLGALVACYKGVSCSIGSNRVGIIKQLPKGCSYITNQDADTVTIDNTVYQLSKVEGEQHV

IKGRPVSSSFDPIKFPEDQFNVALDQVFESIENSQALVDQSNKILNSAESAIGGYIPEAPRDGQAYVRKDGEWVLLSTF

Substitutions to Remove Charge Repulsion or Fill Internal
Cavities in the Prefusion Conformation

HMPV F V84C/A249C, A140C/A147C, K324E, 89-112GSGGSG (SEQ ID NO: 134)

KESYLEESCSTITEGYLSVLRTGWYTNVFTLEVGDVENLTCTDGPSLIKTELDLTKSALRELKTcSA*DQgsggsg*ATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDEDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, K324F, 89-112GSGGSG (SEQ ID NO: 135)

KESYLEESCSTITEGYLSVLRTGWYTNVFTLEVGDVENLTCTDGPSLIKTELDLTKSALRELKTcSA*DQgsggsg*ATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDFDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, K324Q, 89-112GSGGSG (SEQ ID NO: 136)

KESYLEESCSTITEGYLSVLRTGWYTNVFTLEVGDVENLTCTDGPSLIKTELDLTKSALRELKTcSA*DQgsggsg*ATAAA

VTAGIAIAKTIRLESEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDQDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, V191I, 89-112GSGGSG (SEQ ID NO: 137)

KESYLEESCSTITEGYLSVLRTGWYTNVFTLEVGDVENLTCTDGPSLIKTELDLTKSALRELKTcSA*DQgsggsg*ATAAA

VTAGIAIAKTIRLESEVNAIKGCLKTTNECVSTLGNGVRVLATAVRELKEFVSKNLTSAINKNKCDIPDLKMAISFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, V191I, K324E, 89-112GSGGSG (SEQ ID NO: 138)

KESYLEESCSTITEGYLSVLRTGWYTNVFTLEVGDVENLTCTDGPSLIKTELDLTKSALRELKTcSA*DQgsggsg*ATAAA

VTAGIAIAKTIRLESEVNAIKGCLKTTNECVSTLGNGVRVLATAVRELKEFVSKNLTSAINKNKCDIPDLKMAISFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDEDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

Proline Substitutions to Stabilize the Turn Conformation in
the Prefusion Structure and Destabilize the Helical in Post-
fusion Conformation

HMPV F V84C/A249C, A140C/A147C, K143P, 89-112GSGGSG (SEQ ID NO: 139)

KESYLEESCSTITEGYLSVLRTGWYTNVFTLEVGDVENLTCTDGPSLIKTELDLTKSALRELKTcSA*DQ*gsggsgATAAA

VTAGIAIAKTIRLESEVNAIKGCLKPTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, E131P, 89-112GSGGSG (SEQ ID NO: 140)

KESYLEESCSTITEGYLSVLRTGWYTNVFTLEVGDVENLTCTDGPSLIKTELDLTKSALRELKTcSA*DQ*gsggsgATAAA

VTAGIAIAKTIRLPSEVNAIKGCLKTTNECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, N145P, 89-112GSGGSG (SEQ ID NO: 141)

KESYLEESCSTITEGYLSVLRTGWYTNVFTLEVGDVENLTCTDGPSLIKTELDLTKSALRELKTcSA*DQ*gsggsgATAAA

VTAGIAIAKTIRLESEVNAIKGCLKTTPECVSTLGNGVRVLATAVRELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, R163P, 89-112GSGGSG (SEQ ID NO: 142)

KESYLEESCSTITEGYLSVLRTGWYTNVFTLEVGDVENLTCTDGPSLIKTELDLTKSALRELKTcSA*DQ*gsggsgATAAA

VTAGIAIAKTIRLESEVNAIKGCLKTTNECVSTLGNGVRVLATAVPELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, E131P-R163P, 89-112GSGGSG (SEQ ID NO: 143)

KESYLEESCSTITEGYLSVLRTGWYTNVFTLEVGDVENLTCTDGPSLIKTELDLTKSALRELKTcSA*DQ*gsggsgATAAA

VTAGIAIAKTIRLPSEVNAIKGCLKTTNECVSTLGNGVRVLATAVPELKEFVSKNLTSAINKNKCDIPDLKMAVSFSQFN

RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE  SAIGGYIPEAPRDGQAYVRKDGEWVLLSTF

HMPV F V84C/A249C, A140C/A147C, A459P, 89-112GSGGSG (SEQ ID NO: 144)

KESYLEESCSTITEGYLSVLRTGWYTNVFTLEVGDVENLTCTDGPSLIKTELDLTKSALRELKTcSA*DQ*gsggsgATAAA

VTAGIAIAKTIRLESEVNAIKGCLKTTNECVSTLGNGVRVLATAVRELKEFVSKNLTSAINKNKCDIPDLKMAVSFSQFN

-continued

```
RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVPLDQVFESIENSQALVDQSNKILNSAE  SAIGGYIPEAPRDGQAYVRKDGEWVLLSTF
```

HMPV F V84C/A249C, A140C/A147C, E131P-R163P-A459P,
89-112GSGGSG
                                                        (SEQ ID NO: 145)
```
KESYLEESCSTITEGYLSVLRTGWYTNVFTLEVGDVENLTCTDGPSLIKTELDLTKSALRELKTcSADQgsggsgATAAA VTAGIAIAKTIRLPSEVNAIKGCLKkTnECVSTLGNGVRVLATAVPELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVPLDQVFESIENSQALVDQSNKILNSAE  SAIGGYIPEAPRDGQAYVRKDGEWVLLSTF
```
                                20

Additional Combinations of Mutations for Prefusion Stabilization

HMPV F V84C/A249C, A140C/A147C, R163P-A459P, D454C/V458C,
89-112GSGGSG
                                                        (SEQ ID NO: 148)
```
KESYLEESCSTITEGYLSVLRTGWYTNVFTLEVGDVENLTCTDGPSLIKTELDLTKSALRELKTcSADQgsggsgATAAA VTAGIAIAKTIRLeSEVNAIKGCLKkTnECVSTLGNGVRVLATAVPELKEFVSKNLTSAINKNKCDIPDLKMAVSFSQFN RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPECQFNCPLDQVFESIENSQALVDQSNKILNSAE  SAIGGYIPEAPRDGQAYVRKDGEWVLLSTF
```

HMPV F V84C/A249C, A140C/A147C, R163P-A459P, T365C/Q455C,
89-112GSGGSG
                                                        (SEQ ID NO: 149)
```
KESYLEESCSTITEGYLSVLRTGWYTNVFTLEVGDVENLTCTDGPSLIKTELDLTKSALRELKTcSADQgsggsgATAAA VTAGIAIAKTIRLeSEVNAIKGCLKkTnECVSTLGNGVRVLATAVPELKEFVSKNLTSAINKNKCDIPDLKMAVSFSQFN RRFLNVVRQFSDNAGITPAISLDLMTDAELARAVSYMPTSAGQIKLMLENRcMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSCGRHPISMVALSPLGALVACYKGVSCSIGSNRVGIIKQLPKGCSYITNQDADTVTIDNTVYQLSKVEGEQHVI

KGRPVSSSFDPIKFPEDcFNVPLDQVFESIENSQALVDQSNKILNSAE  SAIGGYIPEAPRDGQAYVRKDGEWVLLSTF
```

HMPV F V84C/A249C, A140C/A147C, E131P-R163P-A459P, D454C/V458C,
89-112GSGGSG
                                                        (SEQ ID NO: 150)
```
KESYLEESCSTITEGYLSVLRTGWYTNVFTLEVGDVENLTCTDGPSLIKTELDLTKSALRELKTcSADQgsggsgATAAA VTAGIAIAKTIRLpSEVNAIKGCLKkTnECVSTLGNGVRVLATAVPELKEFVSKNLTSAINKNKCDIPDLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPECQFNCPLDQVFESIENSQALVDQSNKILNSAE  SAIGGYIPEAPRDGQAYVRKDGEWVLLSTF
```

HMPV F V84C/A249C, A140C/A147C, E131P-R163P-A459P, T365C/Q455C,
89-112GSGGSG
                                                        (SEQ ID NO: 151)
```
KESYLEESCSTITEGYLSVLRTGWYTNVFTLEVGDVENLTCTDGPSLIKTELDLTKSALRELKTcSADQgsggsgATAAA VTAGIAIAKTIRLpSEVNAIKGCLKkTnECVSTLGNGVRVLATAVPELKEFVSKNLTSAINKNKCDIPDLKMAVSFSQFN
```

-continued

```
RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNDKDCETRGDHVFCDTAAGINVAEQSRECNINISTT

NYPCKVSCGRHPISMVALSPLGALVACYKGVSCSIGSNRVGIIKQLPKGCSYITNQDADTVTIDNTVYQLSKVEGEQHVI

KGRPVSSSFDPIKFPEDcFNVPLDQVFESIENSQALVDQSNKILNSAE  SAIGGYIPEAPRDGQAYVRKDGEWVLLSTF

NL/1/00 V3BΔ12
                                                            (SEQ ID NO: 152)
KESYLEESCSTITEGYLSVLRTGWYTNVFTLEVGDVENLTCADGPSLIKTELDLTKSALRELRTCSADQgsggsgATAAA

VTAGVAIAKTIRLESEVTAIKNCLKKTNECVSTLGNGVRVLATAVRELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVALDQVFESIENSQALVDQSNRILSSAE SAIGGYIPEAPRDGQAYVRKDGEWVLLSTF

CAN97-83 V3BΔ12
                                                            (SEQ ID NO: 153)
KESYLEESCSTITEGYLSVLRTGWYTNVFTLEVGDVENLTCSDGPSLIKTELDLTKSALRELKTCSADQgsggsgATAAA

VTAGVAIAKTIRLESEVTAIKNCLKTTNECVSTLGNGVRVLATAVRELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVALDQVFENIENSQALVDQSNRILSSAE SAIGGYIPEAPRDGQAYVRKDGEWVLLSTF

NL/17/00 V3BΔ12
                                                            (SEQ ID NO: 154)
KESYLEESCSTITEGYLSVLRTGWYTNVFTLEVGDVENLTCSDGPSLIKTELDLTKSALRELKTCSADQgsggsgATAAA

VTAGVAIAKTIRLESEVTAIKNCLKTTNECVSTLGNGVRVLATAVRELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVALDQVFENIENSQALVDQSNRILSSAE SAIGGYIPEAPRDGQAYVRKDGEWVLLSTF

NCL174 V3BΔ12
                                                            (SEQ ID NO: 155)
KESYLEESCSTITEGYLSVLRTGWYTNVFTLEVGDVENLTCADGPSLIKTELDLTKSALRELKPCSADQgsggsgATAAA

VTAGVAIAKTIRLESEVTAIKNCLKKTNECVSTLGNGVRVLATAVRELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVALDQVFENIENSQALVDQSNRILSSAE SAIGGYIPEAPRDGQAYVRKDGEWVLLSTF

NL/1/99 V3BΔ12
                                                            (SEQ ID NO: 156)
KESYLEESCSTITEGYLSVLRTGWYTNVFTLEVGDVENLTCTDGPSLIKTELDLTKSALRELKTCSADQgsggsgATAAA

VTAGIAIAKTIRLESEVNAIKGCLKQTNECVSTLGNGVRVLATAVRELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSTGRHPISMVALSPLGALVACYKGVSCSIGSNWVGIIKQLPKGCSYITNQDADTVTIDNTVYQLSKVEGEQHVI

KGRPVSSSFDPIKFPEDQFNVALDQVFESIENSQALVDQSNKILNSAE SAIGGYIPEAPRDGQAYVRKDGEWVLLSTF
```

-continued

NDL00-1 V3BΔ12

(SEQ ID NO: 157)

KESYLEESCSTITEGYLSVLRTGWYTNVFTLEVGDVENLTCADGPSLIKTELDLTKSALRELRTCSADQgsggsgATAAA

VTAGVAIAKTIRLESEVTAIKNCLKKTNECVSTLGNGVRVLATAVRELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVALDQVFESIENSQALVDQSNRILSSAE SAIGGYIPEAPRDGQAYVRKDGEWVLLSTF

CAN98-75 V3BΔ12

(SEQ ID NO: 158)

KESYLEESCSTITEGYLSVLRTGWYTNVFTLEVGDVENLTCTDGPSLIKTELDLTKSALRELKTCSADQgsggsgATAAA

VTAGIAIAKTIRLESEVNAIKGCLKTTNECVSTLGNGVRVLATAVRELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVALDQVFESIENSQALVDQSNKILNSAE SAIGGYIPEAPRDGQAYVRKDGEWVLLSTF

NL/1/00 V3BΔ12, E131P-R163P-A459P (SEQ ID NO: 159)

KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVPLDQVFESIENSQALVDQSNRILSSAE SAIGGYIPEAPRDGQAYVRKDGEWVLLSTF

CAN97-83 V3BΔ12, E131P-R163P-A459P (SEQ ID NO: 160)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVPLDQVFENIENSQALVDQSNRILSSAE SAIGGYIPEAPRDGQAYVRKDGEWVLLSTF

NL/17/00 V3BΔ12, E131P-R163P-A459P (SEQ ID NO: 161)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVPLDQVFENIENSQALVDQSNRILSSAE SAIGGYIPEAPRDGQAYVRKDGEWVLLSTF

NCL174 V3BΔ12, E131P-R163P-A459P (SEQ ID NO: 162)

KESYLEESCSTITEGYLSVLRTGWYTNVFTLEVGDVENLTCADGPSLIKTELDLTKSALRELKPCSADQgsggsgATAAA

VTAGVAIAKTIRLPSEVTAIKNCLKKTNECVSTLGNGVRVLATAVPELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

-continued

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVPLDQVFENIENSQALVDQSNRILSSAE SAIGGYIPEAPRDGQAYVRKDGEWVLLSTF

NL/1/99 V3BΔ12, E131P-R163P-A459P (SEQ ID NO: 163)

KESYLEESCSTITEGYLSVLRTGWYTNVFTLEVGDVENLTCTDGPSLIKTELDLTKSALRELKTCSADQgsggsgATAAA

VTAGIAIAKTIRLPSEVNAIKGCLKQTNECVSTLGNGVRVLATAVPELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSTGRHPISMVALSPLGALVACYKGVSCSIGSNWVGIIKQLPKGCSYITNQDADTVTIDNTVYQLSKVEGEQHVI

KGRPVSSSFDPIKFPEDQFNVPLDQVFESIENSQALVDQSNKILNSAE SAIGGYIPEAPRDGQAYVRKDGEWVLLSTF

NDL00-1 V3BΔ12, E131P-R163P-A459P (SEQ ID NO: 164)

KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVPLDQVFESIENSQALVDQSNRILSSAE SAIGGYIPEAPRDGQAYVRKDGEWVLLSTF

CAN98-75 V3BΔ12, E131P-R163P-A459P (SEQ ID NO: 165)

KESYLEESCSTITEGYLSVLRTGWYTNVFTLEVGDVENLTCTDGPSLIKTELDLTKSALRELKTCSADQgsggsgATAAA VTAGIAIAKTIRLPSEVNAIKGCLKTTNECVSTLGNGVRVLATAVPELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVPLDQVFESIENSQALVDQSNKILNSAE SAIGGYIPEAPRDGQAYVRKDGEWVLLSTF

NL/1/00 V3BΔ12, E131P-R163P-A459P, T365C/Q455C (SEQ ID NO: 166)

KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPVKFPEDCFNVPLDQVFESIENSQALVDQSNRILSSAE SAIGGYIPEAPRDGQAYVRKDGEWVLLSTF

CAN97-83 V3BΔ12, E131P-R163P-A459P, T365C/Q455C (SEQ ID NO: 167)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPIKFPEDCFNVPLDQVFENIENSQALVDQSNRILSSAE SAIGGYIPEAPRDGQAYVRKDGEWVLLSTF

NL/17/00 V3BΔ12, E131P-R163P-A459P, T365C/Q455C (SEQ ID NO: 168)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

```
VIDTPCWIVKAAPSCSEKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPIKFPEDCFNVPLDQVFENIENSQALVDQSNRILSSAE SAIGGYIPEAPRDGQAYVRKDGEWVLLSTF

NCL174 V3BΔ12, E131P-R163P-A459P, T365C/Q455C
                                                    (SEQ ID NO: 169)
KESYLEESCSTITEGYLSVLRTGWYTNVFTLEVGDVENLTCADGPSLIKTELDLTKSALRELKPCSADQgsggsgATAAA

VTAGVAIAKTIRLPSEVTAIKNCLKKTNECVSTLGNGVRVLATAVPELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPVKFPEDCFNVPLDQVFENIENSQALVDQSNRILSSAE SAIGGYIPEAPRDGQAYVRKDGEWVLLSTF

NL/1/99 V3BΔ12, E131P-R163P-A459P, T365C/Q455C
                                                    (SEQ ID NO: 170)
KESYLEESCSTITEGYLSVLRTGWYTNVFTLEVGDVENLTCTDGPSLIKTELDLTKSALRELKTCSADQgsggsgATAAA

VTAGIAIAKTIRLPSEVNAIKGCLKQTNECVSTLGNGVRVLATAVPELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSCGRHPISMVALSPLGALVACYKGVSCSIGSNWVGIIKQLPKGCSYITNQDADTVTIDNTVYQLSKVEGEQHVI

KGRPVSSSFDPIKFPEDCFNVPLDQVFESIENSQALVDQSNKILNSAE SAIGGYIPEAPRDGQAYVRKDGEWVLLSTF

NDL00-1 V3BΔ12, E131P-R163P-A459P, T365C/Q455C
                                                    (SEQ ID NO: 171)
KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPVKFPEDCFNVPLDQVFESIENSQALVDQSNRILSSAE SAIGGYIPEAPRDGQAYVRKDGEWVLLSTF

CAN98-75 V3BΔ12, E131P-R163P-A459P, T365C/Q455C
                                                    (SEQ ID NO: 172)
KESYLEESCSTITEGYLSVLRTGWYTNVFTLEVGDVENLTCTDGPSLIKTELDLTKSALRELKTCSADQgsggsgATAAA VTAGIAIAKTIRLPSEVNAIKGCLKTTNECVSTLGNGVRVLATAVPELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

NYPCKVSCGRHPISMVALSPLGALVACYKGVSCSIGSNRVGIIKQLPKGCSYITNQDADTVTIDNTVYQLSKVEGEQHVI

KGRPVSSSFDPIKFPEDCFNVPLDQVFESIENSQALVDQSNKILNSAE SAIGGYIPEAPRDGQAYVRKDGEWVLLSTF

NL/1/00 V3BΔ12, E131P-R163P-A459P, D454C/V458C
                                                    (SEQ ID NO: 173)
KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPECQFNCPLDQVFESIENSQALVDQSNRILSSAE SAIGGYIPEAPRDGQAYVRKDGEWVLLSTF
```

-continued

CAN97-83 V3BΔ12, E131P-R163P-A459P, D454C/V458C (SEQ ID NO: 174)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPECQFNCPLDQVFENIENSQALVDQSNRILSSAE SAIGGYIPEAPRDGQAYVRKDGEWVLLSTF

NL/17/00 V3BΔ12, E131P-R163P-A459P, D454C/V458C (SEQ ID NO: 175)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPECQFNCPLDQVFENIENSQALVDQSNRILSSAE SAIGGYIPEAPRDGQAYVRKDGEWVLLSTF

NCL174 V3BΔ12, E131P-R163P-A459P, D454C/V458C (SEQ ID NO: 176)

KESYLEESCSTITEGYLSVLRTGWYTNVFTLEVGDVENLTCADGPSLIKTELDLTKSALRELKPCSADQgsggsgATAAA

VTAGVAIAKTIRLPSEVTAIKNCLKKTNECVSTLGNGVRVLATAVPELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPECQFNCPLDQVFENIENSQALVDQSNRILSSAE SAIGGYIPEAPRDGQAYVRKDGEWVLLSTF

NL/1/99 V3BΔ12, E131P-R163P-A459P, D454C/V458C (SEQ ID NO: 177)

KESYLEESCSTITEGYLSVLRTGWYTNVFTLEVGDVENLTCTDGPSLIKTELDLTKSALRELKTCSADQgsggsgATAAA

VTAGIAIAKTIRLPSEVNAIKGCLKQTNECVSTLGNGVRVLATAVPELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSTGRHPISMVALSPLGALVACYKGVSCSIGSNWVGIIKQLPKGCSYITNQDADTVTIDNTVYQLSKVEGEQHVI

KGRPVSSSFDPIKFPECQFNCPLDQVFESIENSQALVDQSNKILNSAE SAIGGYIPEAPRDGQAYVRKDGEWVLLSTF

NDL00-1 V3BΔ12, E131P-R163P-A459P, D454C/V458C (SEQ ID NO: 178)

KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPECQFNCPLDQVFESIENSQALVDQSNRILSSAE SAIGGYIPEAPRDGQAYVRKDGEWVLLSTF

CAN98-75 V3BΔ12, E131P-R163P-A459P, D454C/V458C (SEQ ID NO: 179)

KESYLEESCSTITEGYLSVLRTGWYTNVFTLEVGDVENLTCTDGPSLIKTELDLTKSALRELKTCSADQgsggsgATAAA VTAGIAIAKTIRLPSEVNAIKGCLKTTNECVSTLGNGVRVLATAVPELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

-continued

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPECQFNCPLDQVFESIENSQALVDQSNKILNSAE SAIGGYIPEAPRDGQAYVRKDGEWVLLSTF

HMPV F v3BD12_E131P-R163P-A459P_ D454C-V458C_spyT (SEQ ID NO: 209)

MSWKVMIIISLLITPQHGLKESYLEESCSTITEGYLSVLRTGWYTNVFTLEVGDVENLTCTDGPSLIKTELDLTKSALRE

LKTCSADQGSGGSGATAAAVTAGIAIAKTIRLPSEVNAIKGCLKtTNECVSTLGNGVRVLATAVpELKEFVSKNLTSAIN

KNKCDIPDLKMAVSFSQFNRRFLNVVRQFSDNAGITPAISLDLMTDAELARAVSYMPTSAGQIKLMLENRCMVRRKGFGI

LIGVYGSSVIYMVQLPIFGVIDTPCWIIKAAPSCSEKDGNYACLLREDQGWYCKNAGSTVYYPNKKDCETRGDHVFCDTA

AGINVAEQSRECNINISTTNYPCKVSTGRHPISMVALSPLGALVACYKGVSCSIGSNRVGIIKQLPKGCSYITNQDADTV

TIDNTVYQLSKVEGEQHVIKGRPVSSSFDPIKFPECQFNCPLDQVFESIENSQALVDQSNKILNSAESAIGGYIPEAPRD

GQAYVRKDGEWVLLSTFLGgVPTIVMVDAYKRYK

HMPV Fv3BD12-3P-DS2_CAN97-83_A2_spyT (SEQ ID NO: 210)

MSWKVVIIFSLLITPQHGLKESYLEESCSTITEGYLSVLRTGWYTNVFTLEVGDVENLTCSDGPSLIKTELDLTKSALRE

LKTCSADQGSGGSGATAAAVTAGVAIAKTIRLPSEVTAIKNCLKtTNECVSTLGNGVRVLATAVPELKDFVSKNLTRAIN

KNKCDIPDLKMAVSFSQFNRRFLNVVRQFSDNAGITPAISLDLMTDAELARAVSNMPTSAGQIKLMLENRCMVRRKGFGI

LIGVYGSSVIYMVQLPIFGVIDTPCWIVKAAPSCSGKKGNYACLLREDQGWYCQNAGSTVYYPNEKDCETRGDHVFCDTA

AGINVAEQSKECNINISTTNYPCKVSTGRHPISMVALSPLGALVACYKGVSCSIGSNRVGIIKQLNKGCSYITNQDADTV

TIDNTVYQLSKVEGEQHVIKGRPVSSSFDPIKFPECQFNCPLDQVFENIENSQALVDQSNRILSSAESAIGGYIPEAPRD

GQAYVRKDGEWVLLSTFLGgVPTIVMVDAYKRYK

Prefusion, Full-Length Sequences

NL/1/00 A140C/ A147C full-length (SEQ ID NO: 50)

KESYLEESCSTITEGYLSVLRTGWYTNVFTLEVGDVENLTCADGPSLIKTELDLTKSALRELRTVSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN97-83 A140C/ A147C full-length (SEQ ID NO: 51)

KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NL/17/00 A140C/ A147C full-length (SEQ ID NO: 52)

KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

-continued

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NCL174 A140C/A147C full-length (SEQ ID NO: 53)
KESYLEESCSTITEGYLSVLRTGWYTNVFTLEVGDVENLTCADGPSLIKTELDLTKSALRELKPVSADQLAREEQIENPR QSRFVLGAIALGVATAAAVTAGVAIAKTIRLESEVTAIKNCLKKTNECVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEKGNTGFIIVIILIA

VLGSSMILVSVFIIIKKTRKPTGAPPELSGVTNNGFIPHS

NL/1/99 A140C/A147C full-length (SEQ ID NO: 54)
KESYLEESCSTITEGYLSVLRTGWYTNVFTLEVGDVENLTCTDGPSLIKTELDLTKSALRELKTVSADQLAREEQIENPR QSRFVLGAIALGVATAAAVTAGIAIAKTIRLESEVNAIKGCLKQTNECVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVVILVA

VLGLTMISVSIIIIIKKTRKPTGAPPELNGVTNGGFIPHS

NDL00-1 A140C/A147C full-length (SEQ ID NO: 55)
KESYLEESCSTITEGYLSVLRTGWYTNVFTLEVGDVENLTCADGPSLIKTELDLTKSALRELRTVSADQLAREEQIENPR QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN98-75 A140C/A147C full-length (SEQ ID NO: 56)
KESYLEESCSTITEGYLSVLRTGWYTNVFTLEVGDVENLTCTDGPSLIKTELDLTKSALRELKTVSADQLAREEQIENPR QSRFVLGAIALGVATAAAVTAGIAIAKTIRLESEVNAIKGCLKTTNECVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVIILIA

VLGLTMISVSIIIIIKKTRKPTGAPPELNGVTNGGFIPHS

NL/1/00 V84C/A249C full-length (SEQ ID NO: 57)
KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

-continued

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN97-83 V84C/A249C full-length
(SEQ ID NO: 58)
KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NL/17/00 V84C/A249C full-length
(SEQ ID NO: 59)
KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NCL174 V84C/A249C full-length
(SEQ ID NO: 60)
KESYLEESCSTITEGYLSVLRTGWYTNVFTLEVGDVENLTCADGPSLIKTELDLTKSALRELKPCSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRCMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEKGNTGFIIVIILIA

VLGSSMILVSVFIIIKKTRKPTGAPPELSGVTNNGFIPHS

NL/1/99 V84C/A249C full-length
(SEQ ID NO: 61)
KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVVILVA

VLGLTMISVSIIIIIKKTRKPTGAPPELNGVTNGGFIPHS

NDL00-1 V84C/A249C full-length
(SEQ ID NO: 62)
KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

-continued

```
IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN
```

CAN98-75 V84C/A249C full-length
(SEQ ID NO: 63)
```
KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVIILIA

VLGLTMISVSIIIIKKTRKPTGAPPELNGVTNGGFIPHS
```

NL/1/00 V84C/A249C, A140C/A147C full-length
(SEQ ID NO: 64)
```
KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN
```

CAN97-83 V84C/A249C, A140C/A147C full-length
(SEQ ID NO: 65)
```
KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS
```

NL/17/00 V84C/A249C, A140C/A147C full-length
(SEQ ID NO: 66)
```
KESYLEESCSTITEGYLSVLRTGWYTNVFTLEVGDVENLTCSDGPSLIKTELDLTKSALRELKTCSADQLAREEQIENPR

QSRFVLGAIALGVATAAAVTAGVAIAKTIRLESEVTAIKNCLKTTNECVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRCMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS
```

NCL174 V84C/A249C, A140C/A147C full-length
(SEQ ID NO: 67)
```
KESYLEESCSTITEGYLSVLRTGWYTNVFTLEVGDVENLTCADGPSLIKTELDLTKSALRELKPCSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRCMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT
```

-continued

IDNTVYQLSKVEGEQHVIKGRPVSSSFDPVKFPEDQFNVALDQVFENIENSQALVDQSNRILSSAEKGNTGFIIVIILIA

VLGSSMILVSVFIIIKKTRKPTGAPPELSGVTNNGFIPHS

NL/1/99 V84C/A249C, A140C/A147C full-length (SEQ ID NO: 68)
KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGCLKQTNECVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVVILVA

VLGLTMISVSIIIIIKKTRKPTGAPPELNGVTNGGFIPHS

NDL00-1 V84C/A249C, A140C/A147C full-length (SEQ ID NO: 69)
KESYLEESCSTITEGYLSVLRTGWYTNVFTLEVGDVENLTCADGPSLIKTELDLTKSALRELRTCSADQLAREEQIENPR

QSRFVLGAIALGVATAAAVTAGVAIAKTIRLESEVTAIKNCLKKTNECVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRCMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN98-75 V84C/A249C, A140C/A147C full-length (SEQ ID NO: 70)
KESYLEESCSTITEGYLSVLRTGWYTNVFTLEVGDVENLTCTDGPSLIKTELDLTKSALRELKTCSADQLAREEQIENPR

QSRFVLGAIALGVATAAAVTAGIAIAKTIRLESEVNAIKGCLKTTNECVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRCMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVIILIA

VLGLTMISVSIIIIIKKTRKPTGAPPELNGVTNGGFIPHS

NL/1/00 V3BΔ12

(SEQ ID NO: 180)
KESYLEESCSTITEGYLSVLRTGWYTNVFTLEVGDVENLTCADGPSLIKTELDLTKSALRELRTCSADQgsggsgATAAA

VTAGVAIAKTIRLESEVTAIKNCLKKTNECVSTLGNGVRVLATAVRELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVALDQVFESIENSQALVDQSNRILSSAEKGNTGFIIVIILIAVLGSTMILVSVFIIIKKT

KKPTGAPPELSGVTNNGFIPHN

CAN97-83 V3BΔ12

(SEQ ID NO: 181)
KESYLEESCSTITEGYLSVLRTGWYTNVFTLEVGDVENLTCSDGPSLIKTELDLTKSALRELKTCSADQgsggsgATAAA

VTAGVAIAKTIRLESEVTAIKNCLKTTNECVSTLGNGVRVLATAVRELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVALDQVFENIENSQALVDQSNRILSSAEKGNTGFIIVIILIAVLGSSMILVSIFIIIKKT

KKPTGAPPELSGVTNNGFIPHS

NL/17/00 V3BΔ12

(SEQ ID NO: 182)
KESYLEESCSTITEGYLSVLRTGWYTNVFTLEVGDVENLTCSDGPSLIKTELDLTKSALRELKTCSADQgsggsgATAAA

VTAGVAIAKTIRLESEVTAIKNCLKTTNECVSTLGNGVRVLATAVRELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVALDQVFENIENSQALVDQSNRILSSAEKGNTGFIIVIILIAVLGSSMILVSIFIIIKKT

KKPTGAPPELSGVTNNGFIPHS

NCL174 V3BΔ12

(SEQ ID NO: 183)
KESYLEESCSTITEGYLSVLRTGWYTNVFTLEVGDVENLTCADGPSLIKTELDLTKSALRELKPCSADQgsggsgATAAA

VTAGVAIAKTIRLESEVTAIKNCLKKTNECVSTLGNGVRVLATAVRELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVALDQVFENIENSQALVDQSNRILSSAEKGNTGFIIVIILIAVLGSSMILVSVFIIIKKT

RKPTGAPPELSGVTNNGFIPHS

NL/1/99 V3BΔ12

(SEQ ID NO: 184)
KESYLEESCSTITEGYLSVLRTGWYTNVFTLEVGDVENLTCTDGPSLIKTELDLTKSALRELKTCSADQgsggsgATAAA

VTAGIAIAKTIRLESEVNAIKGCLKQTNECVSTLGNGVRVLATAVRELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSTGRHPISMVALSPLGALVACYKGVSCSIGSNWVGIIKQLPKGCSYITNQDADTVTIDNTVYQLSKVEGEQHVI

KGRPVSSSFDPIKFPEDQFNVALDQVFESIENSQALVDQSNKILNSAEKGNTGFIIVVILVAVLGLTMISVSIIIIIKKT

RKPTGAPPELNGVTNGGFIPHS

NDL00-1 V3BΔ12

(SEQ ID NO: 185)
KESYLEESCSTITEGYLSVLRTGWYTNVFTLEVGDVENLTCADGPSLIKTELDLTKSALRELRTCSADQgsggsgATAAA

VTAGVAIAKTIRLESEVTAIKNCLKKTNECVSTLGNGVRVLATAVRELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVALDQVFESIENSQALVDQSNRILSSAEKGNTGFIIVIILIAVLGSTMILVSVFIIIKKT

KKPTGAPPELSGVTNNGFIPHN

CAN98-75 V3BΔ12

(SEQ ID NO: 186)
KESYLEESCSTITEGYLSVLRTGWYTNVFTLEVGDVENLTCTDGPSLIKTELDLTKSALRELKTCSADQgsggsgATAAA

VTAGIAIAKTIRLESEVNAIKGCLKTTNECVSTLGNGVRVLATAVRELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

-continued

KGRPVSSSFDPIKFPEDQFNVALDQVFESIENSQALVDQSNKILNSAEKGNTGFIIVIILIAVLGLTMISVSIIIIKKT

RKPTGAPPELNGVTNGGFIPHS

NL/1/00 V3BΔ12, E131P-R163P-A459P (SEQ ID NO: 187)

KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVPLDQVFESIENSQALVDQSNRILSSAEKGNTGFIIVIILIAVLGSTMILVSVFIIIKKT

KKPTGAPPELSGVTNNGFIPHN

CAN97-83 V3BΔ12, E131P-R163P-A459P (SEQ ID NO: 188)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVPLDQVFENIENSQALVDQSNRILSSAEKGNTGFIIVIILIAVLGSSMILVSIFIIIKKT

KKPTGAPPELSGVTNNGFIPHS

NL/17/00 V3BΔ12, E131P-R163P-A459P (SEQ ID NO: 189)

KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPEDQFNVPLDQVFENIENSQALVDQSNRILSSAEKGNTGFIIVIILIAVLGSSMILVSIFIIIKKT

KKPTGAPPELSGVTNNGFIPHS

NCL174 V3BΔ12, E131P-R163P-A459P (SEQ ID NO: 190)

KESYLEESCSTITEGYLSVLRTGWYTNVFTLEVGDVENLTCADGPSLIKTELDLTKSALRELKPCSADQgsggsgATAAA

VTAGVAIAKTIRLPSEVTAIKNCLKKTNECVSTLGNGVRVLATAVPELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVPLDQVFENIENSQALVDQSNRILSSAEKGNTGFIIVIILIAVLGSSMILVSVFIIIKKT

RKPTGAPPELSGVTNNGFIPHS

NL/1/99 V3BΔ12, E131P-R163P-A459P (SEQ ID NO: 191)

KESYLEESCSTITEGYLSVLRTGWYTNVFTLEVGDVENLTCTDGPSLIKTELDLTKSALRELKTCSADQgsggsgATAAA

VTAGIAIAKTIRLPSEVNAIKGCLKQTNECVSTLGNGVRVLATAVPELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSTGRHPISMVALSPLGALVACYKGVSCSIGSNWVGIIKQLPKGCSYITNQDADTVTIDNTVYQLSKVEGEQHVI

-continued

KGRPVSSSFDPIKFPEDQFNVPLDQVFESIENSQALVDQSNKILNSAEKGNTGFIIVVILVAVLGLTMISVSIIIIIKKT

RKPTGAPPELNGVTNGGFIPHS

NDL00-1 V3BΔ12, E131P-R163P-A459P (SEQ ID NO: 192)
KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPEDQFNVPLDQVFESIENSQALVDQSNRILSSAEKGNTGFIIVIILIAVLGSTMILVSVFIIIKKT

KKPTGAPPELSGVTNNGFIPHN

CAN98-75 V3BΔ12, E131P-R163P-A459P (SEQ ID NO: 193)
KESYLEESCSTITEGYLSVLRTGWYTNVFTLEVGDVENLTCTDGPSLIKTELDLTKSALRELKTCSADQgsggsgATAAA VTAGIAIAKTIRLPSEVNAIKGCLKTTNECVSTLGNGVRVLATAVPELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPEDQFNVPLDQVFESIENSQALVDQSNKILNSAEKGNTGFIIVIILIAVLGLTMISVSIIIIIKKT

RKPTGAPPELNGVTNGGFIPHS

NL/1/00 V3BΔ12, E131P-R163P-A459P, T365C/Q455C (SEQ ID NO: 194)
KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPVKFPEDCFNVPLDQVFESIENSQALVDQSNRILSSAEKGNTGFIIVIILIAVLGSTMILVSVFIIIKKT

KKPTGAPPELSGVTNNGFIPHN

CAN97-83 V3BΔ12, E131P-R163P-A459P, T365C/Q455C (SEQ ID NO: 195)
KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPIKFPEDCFNVPLDQVFENIENSQALVDQSNRILSSAEKGNTGFIIVIILIAVLGSSMILVSIFIIIKKT

KKPTGAPPELSGVTNNGFIPHS

NL/17/00 V3BΔ12, E131P-R163P-A459P, T365C/Q455C (SEQ ID NO: 196)
KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

VIDTPCWIVKAAPSCSEKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

-continued

KGRPVSSSFDPIKFPEDCFNVPLDQVFENIENSQALVDQSNRILSSAEKGNTGFIIVIILIAVLGSSMILVSIFIIIKKT

KKPTGAPPELSGVTNNGFIPHS

NCL174 V3BΔ12, E131P-R163P-A459P, T365C/Q455C (SEQ ID NO: 197)

KESYLEESCSTITEGYLSVLRTGWYTNVFTLEVGDVENLTCADGPSLIKTELDLTKSALRELKPCSADQgsggsgATAAA

VTAGVAIAKTIRLPSEVTAIKNCLKKTNECVSTLGNGVRVLATAVPELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPVKFPEDCFNVPLDQVFENIENSQALVDQSNRILSSAEKGNTGFIIVIILIAVLGSSMILVSVFIIIKKT

RKPTGAPPELSGVTNNGFIPHS

NL/1/99 V3BΔ12, E131P-R163P-A459P, T365C/Q455C (SEQ ID NO: 198)

KESYLEESCSTITEGYLSVLRTGWYTNVFTLEVGDVENLTCTDGPSLIKTELDLTKSALRELKTCSADQgsggsgATAAA

VTAGIAIAKTIRLPSEVNAIKGCLKQTNECVSTLGNGVRVLATAVPELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSCGRHPISMVALSPLGALVACYKGVSCSIGSNWVGIIKQLPKGCSYITNQDADTVTIDNTVYQLSKVEGEQHVI

KGRPVSSSFDPIKFPEDCFNVPLDQVFESIENSQALVDQSNKILNSAEKGNTGFIIVVILVAVLGLTMISVSIIIIKKT

RKPTGAPPELNGVTNGGFIPHS

NDL00-1 V3BΔ12, E131P-R163P-A459P, T365C/Q455C (SEQ ID NO: 199)

KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSCGRHPISMVALSPLGALVACYKGVSCSIGSNRVGIIKQLNKGCSYITNQDADTVTIDNTVYQLSKVEGEQHVI

KGRPVSSSFDPVKFPEDCFNVPLDQVFESIENSQALVDQSNRILSSAEKGNTGFIIVIILIAVLGSTMILVSVFIIIKKT

KKPTGAPPELSGVTNNGFIPHN

CAN98-75 V3BΔ12, E131P-R163P-A459P, T365C/Q455C (SEQ ID NO: 200)

KESYLEESCSTITEGYLSVLRTGWYTNVFTLEVGDVENLTCTDGPSLIKTELDLTKSALRELKTCSADQgsggsgATAAA VTAGIAIAKTIRLPSEVNAIKGCLKTTNECVSTLGNGVRVLATAVPELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

NYPCKVSCGRHPISMVALSPLGALVACYKGVSCSIGSNRVGIIKQLPKGCSYITNQDADTVTIDNTVYQLSKVEGEQHVI

KGRPVSSSFDPIKFPEDCFNVPLDQVFESIENSQALVDQSNKILNSAEKGNTGFIIVIILIAVLGLTMISVSIIIIKKT

RKPTGAPPELNGVTNGGFIPHS

NL/1/00 V3BΔ12, E131P-R163P-A459P, D454C/V458C (SEQ ID NO: 201)

KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPECQFNCPLDQVFESIENSQALVDQSNRILSSAEKGNTGFIIVIILIAVLGSTMILVSVFIIIKKT

KKPTGAPPELSGVTNNGFIPHN

CAN97-83 V3BΔ12, E131P-R163P-A459P, D454C/V458C (SEQ ID NO: 202)
KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPECQFNCPLDQVFENIENSQALVDQSNRILSSAEKGNTGFIIVIILIAVLGSSMILVSIFIIIKKT

KKPTGAPPELSGVTNNGFIPHS

NL/17/00 V3BΔ12, E131P-R163P-A459P, D454C/V458C (SEQ ID NO: 203)
KESYLEESCSTITEGYLSVLRTGWYTNVFTLEVGDVENLTCSDGPSLIKTELDLTKSALRELKTCSADQgsggsgATAAA

VTAGVAIAKTIRLPSEVTAIKNCLKTTNECVSTLGNGVRVLATAVPELKDFVSKNLTRAINKNKCDIDDLKMAVSFSQFN

RRFLNVVRQFSDNAGITPAISLDLMTDAELARAVSNMPTSAGQIKLMLENRCMVRRKGFGILIGVYGSSVIYTVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPIKFPECQFNCPLDQVFENIENSQALVDQSNRILSSAEKGNTGFIIVIILIAVLGSSMILVSIFIIIKKT

KKPTGAPPELSGVTNNGFIPHS

NCL174 V3BΔ12, E131P-R163P-A459P, D454C/V458C (SEQ ID NO: 204)
KESYLEESCSTITEGYLSVLRTGWYTNVFTLEVGDVENLTCADGPSLIKTELDLTKSALRELKPCSADQgsggsgATAAA

VTAGVAIAKTIRLPSEVTAIKNCLKKTNECVSTLGNGVRVLATAVPELKDFVSKNLTRAINKNKCDIDDLKMAVSFSQFN

RRFLNVVRQFSDNAGITPAISLDLMTDAELARAVSNMPTAAGQIKLMLENRCMVRRKGFGILIGVYGSSVIYMVQLPIFG

VIDTPCWIVKAAPSCSEKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

KGRPVSSSFDPVKFPECQFNCPLDQVFENIENSQALVDQSNRILSSAEKGNTGFIIVIILIAVLGSSMILVSVFIIIKKT

RKPTGAPPELSGVTNNGFIPHS

NL/1/99 V3BΔ12, E131P-R163P-A459P, D454C/V458C (SEQ ID NO: 205)
KESYLEESCSTITEGYLSVLRTGWYTNVFTLEVGDVENLTCTDGPSLIKTELDLTKSALRELKTCSADQgsggsgATAAA

VTAGIAIAKTIRLPSEVNAIKGCLKQTNECVSTLGNGVRVLATAVPELKEFVSKNLTSAINRNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKNGNYACLLREDQGWYCKNAGSTVYYPNEKDCETRGDHVFCDTAAGINVAEQSRECNINISTT

NYPCKVSTGRHPISMVALSPLGALVACYKGVSCSIGSNWVGIIKQLPKGCSYITNQDADTVTIDNTVYQLSKVEGEQHVI

KGRPVSSSFDPIKFPECQFNCPLDQVFESIENSQALVDQSNKILNSAEKGNTGFIIVVILVAVLGLTMISVSIIIIKKT

RKPTGAPPELNGVTNGGFIPHS

NDL00-1 V3BΔ12, E131P-R163P-A459P, D454C/V458C (SEQ ID NO: 206)
KESYLEESCSTITEGYLSVLRTGWYTNVFTLEVGDVENLTCADGPSLIKTELDLTKSALRELRTCSADQgsggsgATAAA

VTAGVAIAKTIRLPSEVTAIKNCLKKTNECVSTLGNGVRVLATAVPELKDFVSKNLTRAINKNKCDIADLKMAVSFSQFN

RRFLNVVRQFSDNAGITPAISLDLMTDAELARAVSNMPTSAGQIKLMLENRCMVRRKGFGFLIGVYGSSVIYMVQLPIFG

VIDTPCWIVKAAPSCSGKKGNYACLLREDQGWYCQNAGSTVYYPNEKDCETRGDHVFCDTAAGINVAEQSKECNINISTT

NYPCKVSTGRHPISMVALSPLGALVACYKGVSCSIGSNRVGIIKQLNKGCSYITNQDADTVTIDNTVYQLSKVEGEQHVI

-continued

KGRPVSSSFDPVKFPECQFNCPLDQVFESIENSQALVDQSNRILSSAEKGNTGFIIVIILIAVLGSTMILVSVFIIIKKT

KKPTGAPPELSGVTNNGFIPHN

CAN98-75 V3BΔ12, E131P-R163P-A459P, D454C/V458C (SEQ ID NO: 207)
KESYLEESCSTITEGYLSVLRTGWYTNVFTLEVGDVENLTCTDGPSLIKTELDLTKSALRELKTCSADQgsggsgATAAA VTAGIAIAKTIRLPSEVNAIKGCLKTTNECVSTLGNGVRVLATAVPELKEFVSKNLTSAINKNKCDIADLKMAVSFSQFN

RRFLNVVRQFSDNAGITPAISLDLMTDAELARAVSYMPTSAGQIKLMLENRCMVRRKGFGILIGVYGSSVIYMVQLPIFG

VIDTPCWIIKAAPSCSEKDGNYACLLREDQGWYCKNAGSTVYYPNKKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPIKFPPECQFNCPLDQVFESIENSQALVDQSNKILNSAEKGNTGFIIVIILIAVLGLTMISVSIIIIIKKT

RKPTGAPPELNGVTNGGFIPHS

Postfusion, Foldon Domain Sequences

NL/1/00 60C/G63C (SEQ ID NO: 29)
KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN97-83 60C/G63C (SEQ ID NO: 30)
KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NL/17/00 60C/G63C (SEQ ID NO: 31)
KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NCL174 60C/G63C (SEQ ID NO: 32)
KESYLEESCSTITEGYLSVLRTGWYTNVFTLEVGDVENLTCADCPSLIKTELDLTKSALRELKPVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

-continued

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEGGYIPEAPRDGQAY

VRKDGEWVLLSTF

NL/1/99 60C/G63C (SEQ ID NO: 33)

KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NDL00-1 60C/G63C (SEQ ID NO: 34)

KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN98-75 60C/G63C (SEQ ID NO: 35)

KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NL/1/00 182C/188C (SEQ ID NO: 36)

KESYLEESCSTITEGYLSVLRTGWYTNVFTLEVGDVENLTCADGPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN97-83 182C/188C (SEQ ID NO: 37)

KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

-continued

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NL/17/00 182C/188C (SEQ ID NO: 38)
KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NCL174 182C/188C (SEQ ID NO: 39)
KESYLEESCSTITEGYLSVLRTGWYTNVFTLEVGDVENLTCADGPSLIKTELDLTKSALRELKPVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLCMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEGGYIPEAPRDGQAY

VRKDGEWVLLSTF

NL/1/99 182C/188C (SEQ ID NO: 40)
KESYLEESCSTITEGYLSVLRTGWYTNVFTLEVGDVENLTCTDGPSLIKTELDLTKSALRELKTVSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NDL00-1 182C/188C (SEQ ID NO: 41)
KESYLEESCSTITEGYLSVLRTGWYTNVFTLEVGDVENLTCADGPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN98-75 182C/188C (SEQ ID NO: 42)
KESYLEESCSTITEGYLSVLRTGWYTNVFTLEVGDVENLTCTDGPSLIKTELDLTKSALRELKTVSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

-continued

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NL/1/00 60C/G63C, 182C/188C (SEQ ID NO: 43)

KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN97-83 60C/G63C, 182C/188C (SEQ ID NO: 44)

KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NL/17/00 60C/G63C, 182C/188C (SEQ ID NO: 45)

KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEGGYIPEAPRDGQAY

VRKDGEWVLLSTF

NCL174 60C/G63C, 182C/188C (SEQ ID NO: 46)

KESYLEESCSTITEGYLSVLRTGWYTNVFTLEVGDVENLTCADCPSLIKTELDLTKSALRELKPVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLCMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEGGYIPEAPRDGQAY

VRKDGEWVLLSTF

NL/1/99 60C/G63C, 182C/188C (SEQ ID NO: 47)

KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

NDL00-1 60C/G63C, 182C/188C (SEQ ID NO: 48)

KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEGGYIPEAPRDGQAY

VRKDGEWVLLSTF

CAN98-75 60C/G63C, 182C/188C (SEQ ID NO: 49)

KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEGGYIPEAPRDGQAY

VRKDGEWVLLSTF

Postfusion Ectodomain Sequences

HMPV F PRQSRFVL98-106RRRRR(POST), T49C/V436C (SEQ ID NO: 211)

KESYLEESCSTITEGYLSVLRTGWYTNVFCLEVGDVENLTCTDGPSLIKTELDLTKSALRELKTVSADQLAREEQIENRR

RRRAIALGVATAAAVTAGIAIAKTIRLESEVNAIKGALKTTNEAVSTLGNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHCIKGRPVSSSFDPIKFPEDQFNVALDQVFESIENSQALVDQSNKILNSAE

HMPV F PRQSRFVL98-106RRRRR(POST), T150C/S470C (SEQ ID NO: 212)

KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKG<u>ALKTTNEAVSCL</u>GNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKGRPVSSSFDPIKFPEDQFNVALDQVFESIEN<u>C</u>QALVDQSNKILNSAE

HMPV F PRQSRFVL98-106RRRRR(POST), K143C/S477C (SEQ ID NO: 213)

KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKG<u>ALCTTNEAVST</u>LGNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKGRPVSSSFDPIKFPEDQFNVALDQVFESIEN<u>SQALVDQC</u>NKILNSAE

-continued

HMPV F PRQSRFVL98-106RRRRR(POST), N145C/V474C (SEQ ID NO: 214)
KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKGALKTTCEAVSTLGNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKGRPVSSSFDPIKFPEDQFNVALDQVFESIENSQALCDQSNKILNSAE

HMPV F PRQSRFVL98-106RRRRR(POST), A147C/L473C (SEQ ID NO: 215)
KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKGALKTTNECVSTLGNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKGRPVSSSFDPIKFPEDQFNVALDQVFESIENSQACVDQSNKILNSAE

HMPV F PRQSRFVL98-106RRRRR(POST), V55C/V442C (SEQ ID NO: 216)
KESYLEESCSTITEGYLSVLRTGWYTNVFTLEVGDCENLTCTDGPSLIKTELDLTKSALRELKTVSADQLAREEQIENRR

RRRAIALGVATAAAVTAGIAIAKTIRLESEVNAIKGALKTTNEAVSTLGNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKGRPCSSSFDPIKFPEDQFNVALDQVFESIENSQALVDQSNKILNSAE

HMPV F PRQSRFVL98-106RRRRR(POST), N197C/G439C (SEQ ID NO: 217)
KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKGALKTTNEAVSTLGNGVRVLATAVRELKEFVSKNLTSAINKNKCD

IADLKMAVSFSQFcRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKcRPVSSSFDPIKFPEDQFNVALDQVFESIENSQALVDQSNKILNSAE

HMPV F PRQSRFVL98-106RRRRR(POST), A314C/D421C (SEQ ID NO: 218)
KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKGALKTTNEAVSTLGNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNCGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTICNT

VYQLSKVEGEQHVIKGRPVSSSFDPIKFPEDQFNVALDQVFESIENSQALVDQSNKILNSAE

HMPV F PRQSRFVL98-106RRRRR(POST), V388C/G315C (SEQ ID NO: 219)
KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKGALKTTNEAVSTLGNGVRVLATAVRELKEFVSKNLTSAINKNKCD

IADLKMAVSFSQFNRRFLNVVRQFSDNAGITPAISLDLMTDAELARAVSYMPTSAGQIKLMLENRAMVRRKGFGILIGVY

GSSVIYMVQLPIFGVIDTPCWIIKAAPSCSEKDGNYACLLREDQGWYCKNAcSTVYYPNDKDCETRGDHVFCDTAAGINV

-continued

AEQSRECNINISTTNYPCKVSTGRHPISMVALSPLGALVACYKGcSCSIGSNRVGIIKQLPKGCSYITNQDADTVTIDNT

VYQLSKVEGEQHVIKGRPVSSSFDPIKFPEDQFNVALDQVFESIENSQALVDQSNKILNSAE

HMPV F PRQSRFVL98-106RRRRR(POST), T214C/G257C (SEQ ID NO: 220)

KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKGALKTTNEAVSTLGNGVRVLATAVRELKEFVSKNLTSAINKNKCD

IADLKMAVSFSQFNRRFLNVVRQFSDNAGIcPAISLDLMTDAELARAVSYMPTSAGQIKLMLENRAMVRRKGFcILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKGRPVSSSFDPIKFPEDQFNVALDQVFESIENSQALVDQSNKILNSAE

HMPV F PRQSRFVL98-106RRRRR(POST), A211C/R252C (SEQ ID NO: 221)

KESYLEESCSTITEGYLSVLRTGWYTNVFTLEVGDVENLTCTDGPSLIKTELDLTKSALRELKTVSADQLAREEQIENRR

RRRAIALGVATAAAVTAGIAIAKTIRLESEVNAIKGALKTTNEAVSTLGNGVRVLATAVRELKEFVSKNLTSAINKNKCD

IADLKMAVSFSQFNRRFLNVVRQFSDNcGITPAISLDLMTDAELARAVSYMPTSAGQIKLMLENRAMVCRKGFGILIGVY

GSSVIYMVQLPIFGVIDTPCWIIKAAPSCSEKDGNYACLLREDQGWYCKNAGSTVYYPNDKDCETRGDHVFCDTAAGINV

AEQSRECNINISTTNYPCKVSTGRHPISMVALSPLGALVACYKGVSCSIGSNRVGIIKQLPKGCSYITNQDADTVTIDNT

VYQLSKVEGEQHVIKGRPVSSSFDPIKFPEDQFNVALDQVFESIENSQALVDQSNKILNSAE

HMPV F 97-102GGGGGG, G63C, K188C, A140C/A147C, T49C/V436C (SEQ ID NO: 222)

KESYLEESCSTITEGYLSVLRTGWYTNVFCLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHCIKGRPVSSSFDPIKFPEDQFNVALDQVFESIENSQALVDQSNKILNSAE

HMPV F 97-102GGGGGG, G63C, K188C, A140C/A147C, T150C/S470C (SEQ ID NO: 223)

KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSCLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENCQALVDQSNKILNSAE

HMPV F 97-102GGGGGG, G63C, K188C, A140C/A147C, K143C/S477C (SEQ ID NO: 224)

KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLCTTNECVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQCNKILNSAE

HMPV F 97-102GGGGGG, G63C, K188C, A140C/A147C, N145C/V474C (SEQ ID NO: 225)

KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTCECVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

```
IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQACVDQSNKILNSAE

HMPV F 97-102GGGGGG, G63C, K188C, A140C/A147C, V55C/V442C
                                                  (SEQ ID NO: 226)
KESYLEESCSTITEGYLSVLRTGWYTNVFTLEVGDCENLTCTDCPSLIKTELDLTKSALRELKTVSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPCSSSFDPIKFPEDQFNVALDQVFESIENSQALVDQSNKILNSAE

HMPV F 97-102GGGGGG, G63C, K188C, A140C/A147C, N197C/G439C
                                                  (SEQ ID NO: 227)
KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIADLCMAVSFSQFCRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKCRPVSSSFDPIKFPEDQFNVALDQVFESIENSQALVDQSNKILNSAE

HMPV F 97-102GGGGGG, G63C, K188C, A140C/A147C, A314C/D421C
                                                  (SEQ ID NO: 228)
KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNCGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

ICNTVYQLSKVEGEQHVIKGRPVSSSFDPIKFPEDQFNVALDQVFESIENSQALVDQSNKILNSAE

HMPV F 97-102GGGGGG, G63C, K188C, A140C/A147C, T214C/G257C
                                                  (SEQ ID NO: 229)
KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIADLCMAVSFSQFNRRFLNVVRQFSDNAGICPAISLDLMTDAELARAVSYMPTSAGQIKLMLENRAMVRRKGFCIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAE

HMPV F 97-102GGGGGG, G63C, K188C, A140C/A147C, A211C/R252C
                                                  (SEQ ID NO: 230)
KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSTLGNGVRVLATAVRELKEFVSKNLTSAINK

NKCDIADLCMAVSFSQFNRRFLNVVRQFSDNCGITPAISLDLMTDAELARAVSYMPTSAGQIKLMLENRAMVCRKGFGIL

IGVYGSSVIYMVQLPIFGVIDTPCWIIKAAPSCSEKDGNYACLLREDQGWYCKNAGSTVYYPNDKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAE
```

Postfusion Stabilization with Partial or Complete Removal
the Invisible Region on the EM Structure (D91-180)

HMPV F 97-102GGGGGG, G63C, K188C, A140C/A147C, Δ103-180

(SEQ ID NO: 231)

KESYLEESCSTITEGYLSVLRTGWYTNVFTLEVGDVENLTCTDCPSLIKTELDLTKSALRELKTVSADQLAREEQIEGGG

GGGKCDIADLCMAVSFSQFNRRFLNVVRQFSDNAGITPAISLDLMTDAELARAVSYMPTSAGQIKLMLENRAMVRRKGFG

ILIGVYGSSVIYMVQLPIFGVIDTPCWIIKAAPSCSEKDGNYACLLREDQGWYCKNAGSTVYYPNDKDCETRGDHVFCDT

AAGINVAEQSRECNINISTTNYPCKVSTGRHPISMVALSPLGALVACYKGVSCSIGSNRVGIIKQLPKGCSYITNQDADT

VTIDNTVYQLSKVEGEQHVIKGRPVSSSFDPICFPEDQFNVALDQVFESIENCQALVDQSNKILNSAESAI  GGYIPEA

PRDGQAYVRKDGEWVLLSTF

HMPV F 97-102GGGGGG, G63C, K188C, A140C/A147C, Δ115-180

(SEQ ID NO: 232)

KESYLEESCSTITEGYLSVLRTGWYTNVFTLEVGDVENLTCTDCPSLIKTELDLTKSALRELKTVSADQLAREEQIEGGG

GGGFVLGAIALGVATKCDIADLCMAVSFSQFNRRFLNVVRQFSDNAGITPAISLDLMTDAELARAVSYMPTSAGQIKLML

ENRAMVRRKGFGILIGVYGSSVIYMVQLPIFGVIDTPCWIIKAAPSCSEKDGNYACLLREDQGWYCKNAGSTVYYPNDKD

CETRGDHVFCDTAAGINVAEQSRECNINISTTNYPCKVSTGRHPISMVALSPLGALVACYKGVSCSIGSNRVGIIKQLPK

GCSYITNQDADTVTIDNTVYQLSKVEGEQHVIKGRPVSSSFDPICFPEDQFNVALDQVFESIENCQALVDQSNKILNSAE

SAI  GGYIPEAPRDGQAYVRKDGEWVLLSTF

HMPV F 97-102GGGGGG, G63C, K188C, A140C/A147C, Δ127-180

(SEQ ID NO: 233)

KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKKCDIADLCMAVSFSQFNRRFLNVVRQFSDNAGITPAISLDLMTDAELARAVSY

MPTSAGQIKLMLENRAMVRRKGFGILIGVYGSSVIYMVQLPIFGVIDTPCWIIKAAPSCSEKDGNYACLLREDQGWYCKN

AGSTVYYPNDKDCETRGDHVFCDTAAGINVAEQSRECNINISTTNYPCKVSTGRHPISMVALSPLGALVACYKGVSCSIG

SNRVGIIKQLPKGCSYITNQDADTVTIDNTVYQLSKVEGEQHVIKGRPVSSSFDPICFPEDQFNVALDQVFESIENCQAL

VDQSNKILNSAESAI  GGYIPEAPRDGQAYVRKDGEWVLLSTF

HMPV F 97-102GGGGGG, G63C, K188C, A140C/A147C, Δ139-180

(SEQ ID NO: 234)

KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKKCDIADLCMAVSFSQFNRRFLNVVRQFSDNAGITPAISLDL

MTDAELARAVSYMPTSAGQIKLMLENRAMVRRKGFGILIGVYGSSVIYMVQLPIFGVIDTPCWIIKAAPSCSEKDGNYAC

LLREDQGWYCKNAGSTVYYPNDKDCETRGDHVFCDTAAGINVAEQSRECNINISTTNYPCKVSTGRHPISMVALSPLGAL

VACYKGVSCSIGSNRVGIIKQLPKGCSYITNQDADTVTIDNTVYQLSKVEGEQHVIKGRPVSSSFDPICFPEDQFNVALD

QVFESIENCQALVDQSNKILNSAESAI  GGYIPEAPRDGQAYVRKDGEWVLLSTF

HMPV F 97-102GGGGGG, G63C, K188C, A140C/A147C, Δ151-180

(SEQ ID NO: 235)

KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSTKCDIADLCMAVSFSQFNRRFLNVVRQFSD

NAGITPAISLDLMTDAELARAVSYMPTSAGQIKLMLENRAMVRRKGFGILIGVYGSSVIYMVQLPIFGVIDTPCWIIKAA

PSCSEKDGNYACLLREDQGWYCKNAGSTVYYPNDKDCETRGDHVFCDTAAGINVAEQSRECNINISTTNYPCKVSTGRHP

ISMVALSPLGALVACYKGVSCSIGSNRVGIIKQLPKGCSYITNQDADTVTIDNTVYQLSKVEGEQHVIKGRPVSSSFDPI

CFPEDQFNVALDQVFESIENCQALVDQSNKILNSAESAI  GGYIPEAPRDGQAYVRKDGEWVLLSTF

HMPV F 97-102GGGGGG, G63C, K188C, A140C/A147C, Δ163-180

(SEQ ID NO: 236)

KESYLEESCSTITEGYLSVLRTGWYTNVFTLEVGDVENLTCTDCPSLIKTELDLTKSALRELKTVSADQLAREEQIEGGG

GGGFVLGAIALGVATAAAVTAGIAIAKTIRLESEVNAIKGCLKTTNECVSTLGNGVRVLATAVKCDIADLCMAVSFSQFN

RRFLNVVRQFSDNAGITPAISLDLMTDAELARAVSYMPTSAGQIKLMLENRAMVRRKGFGILIGVYGSSVIYMVQLPIFG

-continued

```
VIDTPCWIIKAAPSCSEKDGNYACLLREDQGWYCKNAGSTVYYPNDKDCETRGDHVFCDTAAGINVAEQSRECNINISTT

NYPCKVSTGRHPISMVALSPLGALVACYKGVSCSIGSNRVGIIKQLPKGCSYITNQDADTVTIDNTVYQLSKVEGEQHVI

KGRPVSSSFDPICFPEDQFNVALDQVFESIENCQALVDQSNKILNSAESAI  GGYIPEAPRDGQAYVRKDGEWVLLSTF

HMPV F 97-102GGGGGG, G63C, K188C, A140C/A147C, Δ103-173
                                                               (SEQ ID NO: 237)
KESYLEESCSTITEGYLSVLRTGWYTNVFTLEVGDVENLTCTDCPSLIKTELDLTKSALRELKTVSADQLAREEQIEGGG

GGGSAINKNKCDIADLCMAVSFSQFNRRFLNVVRQFSDNAGITPAISLDLMTDAELARAVSYMPTSAGQIKLMLENRAMV

RRKGFGILIGVYGSSVIYMVQLPIFGVIDTPCWIIKAAPSCSEKDGNYACLLREDQGWYCKNAGSTVYYPNDKDCETRGD

HVFCDTAAGINVAEQSRECNINISTTNYPCKVSTGRHPISMVALSPLGALVACYKGVSCSIGSNRVGIIKQLPKGCSYIT

NQDADTVTIDNTVYQLSKVEGEQHVIKGRPVSSSFDPICFPEDQFNVALDQVFESIENCQALVDQSNKILNSAESAI  G

GYIPEAPRDGQAYVRKDGEWVLLSTF

HMPV F 97-102GGGGGG, G63C, K188C, A140C/A147C, Δ103-162
                                                               (SEQ ID NO: 238)
KESYLEESCSTITEGYLSVLRTGWYTNVFTLEVGDVENLTCTDCPSLIKTELDLTKSALRELKTVSADQLAREEQIEGGG

GGGRELKEFVSKNLTSAINKNKCDIADLCMAVSFSQFNRRFLNVVRQFSDNAGITPAISLDLMTDAELARAVSYMPTSAG

QIKLMLENRAMVRRKGFGILIGVYGSSVIYMVQLPIFGVIDTPCWIIKAAPSCSEKDGNYACLLREDQGWYCKNAGSTVY

YPNDKDCETRGDHVFCDTAAGINVAEQSRECNINISTTNYPCKVSTGRHPISMVALSPLGALVACYKGVSCSIGSNRVGI

IKQLPKGCSYITNQDADTVTIDNTVYQLSKVEGEQHVIKGRPVSSSFDPICFPEDQFNVALDQVFESIENCQALVDQSNK

ILNSAESAI  GGYIPEAPRDGQAYVRKDGEWVLLSTF

HMPV F 97-102GGGGGG, G63C, K188C, A140C/A147C, Δ103-150
                                                               (SEQ ID NO: 239)
KESYLEESCSTITEGYLSVLRTGWYTNVFTLEVGDVENLTCTDCPSLIKTELDLTKSALRELKTVSADQLAREEQIEGGG

GGGLGNGVRVLATAVRELKEFVSKNLTSAINKNKCDIADLCMAVSFSQFNRRFLNVVRQFSDNAGITPAISLDLMTDAEL

ARAVSYMPTSAGQIKLMLENRAMVRRKGFGILIGVYGSSVIYMVQLPIFGVIDTPCWIIKAAPSCSEKDGNYACLLREDQ

GWYCKNAGSTVYYPNDKDCETRGDHVFCDTAAGINVAEQSRECNINISTTNYPCKVSTGRHPISMVALSPLGALVACYKG

VSCSIGSNRVGIIKQLPKGCSYITNQDADTVTIDNTVYQLSKVEGEQHVIKGRPVSSSFDPICFPEDQFNVALDQVFESI

ENCQALVDQSNKILNSAESAI  GGYIPEAPRDGQAYVRKDGEWVLLSTF

HMPV F 97-102GGGGGG, G63C, K188C, A140C/A147C, Δ103-148
                                                               (SEQ ID NO: 240)
KESYLEESCSTITEGYLSVLRTGWYTNVFTLEVGDVENLTCTDCPSLIKTELDLTKSALRELKTVSADQLAREEQIEGGG

GGGGCLKTTNECVSTLGNGVRVLATAVRELKEFVSKNLTSAINKNKCDIADLCMAVSFSQFNRRFLNVVRQFSDNAGITP

AISLDLMTDAELARAVSYMPTSAGQIKLMLENRAMVRRKGFGILIGVYGSSVIYMVQLPIFGVIDTPCWIIKAAPSCSEK

DGNYACLLREDQGWYCKNAGSTVYYPNDKDCETRGDHVFCDTAAGINVAEQSRECNINISTTNYPCKVSTGRHPISMVAL

SPLGALVACYKGVSCSIGSNRVGIIKQLPKGCSYITNQDADTVTIDNTVYQLSKVEGEQHVIKGRPVSSSFDPICFPEDQ

FNVALDQVFESIENCQALVDQSNKILNSAESAI  GGYIPEAPRDGQAYVRKDGEWVLLSTF

HMPV F 97-102GGGGGG, G63C, K188C, A140C/A147C, Δ103-126
                                                               (SEQ ID NO: 241)
KESYLEESCSTITEGYLSVLRTGWYTNVFTLEVGDVENLTCTDCPSLIKTELDLTKSALRELKTVSADQLAREEQIEGGG

GGGTIRLESEVNAIKGCLKTTNECVSTLGNGVRVLATAVRELKEFVSKNLTSAINKNKCDIADLCMAVSFSQFNRRFLNV

VRQFSDNAGITPAISLDLMTDAELARAVSYMPTSAGQIKLMLENRAMVRRKGFGILIGVYGSSVIYMVQLPIFGVIDTPC

WIIKAAPSCSEKDGNYACLLREDQGWYCKNAGSTVYYPNDKDCETRGDHVFCDTAAGINVAEQSRECNINISTTNYPCKV

STGRHPISMVALSPLGALVACYKGVSCSIGSNRVGIIKQLPKGCSYITNQDADTVTIDNTVYQLSKVEGEQHVIKGRPVS

SSFDPICFPEDQFNVALDQVFESIENCQALVDQSNKILNSAESAI  GGYIPEAPRDGQAYVRKDGEWVLLSTF

HMPV F 97-102GGGGGG, G63C, K188C, A140C/A147C, Δ103-114
                                                               (SEQ ID NO: 242)
KESYLEESCSTITEGYLSVLRTGWYTNVFTLEVGDVENLTCTDCPSLIKTELDLTKSALRELKTVSADQLAREEQIEGGG

GGGAAAVTAGIAIAKTIRLESEVNAIKGCLKTTNECVSTLGNGVRVLATAVRELKEFVSKNLTSAINKNKCDIADLCMAV
```

-continued

SFSQFNRRFLNVVRQFSDNAGITPAISLDLMTDAELARAVSYMPTSAGQIKLMLENRAMVRRKGFGILIGVYGSSVIYMV

QLPIFGVIDTPCWIIKAAPSCSEKDGNYACLLREDQGWYCKNAGSTVYYPNDKDCETRGDHVFCDTAAGINVAEQSRECN

INISTTNYPCKVSTGRHPISMVALSPLGALVACYKGVSCSIGSNRVGIIKQLPKGCSYITNQDADTVTIDNTVYQLSKVE

GEQHVIKGRPVSSSFDPICFPEDQFNVALDQVFESIENCQALVDQSNKILNSAESAI  GGYIPEAPRDGQAYVRKDGEW

VLLSTF

Postfusion, Full-Length Sequences

NL/1/00 60C/G63C full-length
                                                                     (SEQ ID NO: 71)
KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNLKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN97-83 60C/G63C full-length
                                                                     (SEQ ID NO: 72)
KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NL/17/00 60C/G63C full-length
                                                                     (SEQ ID NO: 73)
KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLKMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NCL174 60C/G63C full-length
                                                                     (SEQ ID NO: 74)
KESYLEESCSTITEGYLSVLRTGWYTNVFTLEVGDVENLTCADCPSLIKTELDLTKSALRELKPVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLKMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEKGNTGFIIVIILIA

VLGSSMILVSVFIIIKKTRKPTGAPPELSGVTNNGFIPHS

-continued

NL/1/99 60C/G63C full-length
                                                                                    (SEQ ID NO: 75)
KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVVILVA

VLGLTMISVSIIIIIKKTRKPTGAPPELNGVTNGGFIPHS

NDL00-1 60C/G63C full-length
                                                                                    (SEQ ID NO: 76)
KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLKMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN98-75 60C/G63C full-length
                                                                                    (SEQ ID NO: 77)
KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLKMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVIILIA

VLGLTMISVSIIIIIKKTRKPTGAPPELNGVTNGGFIPHS

NL/1/00 182C/188C full-length
                                                                                    (SEQ ID NO: 78)
KESYLEESCSTITEGYLSVLRTGWYTNVFTLEVGDVENLTCADGPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN97-83 182C/188C full-length
                                                                                    (SEQ ID NO: 79)
KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

-continued

NL/17/00 182C/188C full-length (SEQ ID NO: 80)

KESYLEESCSTITEGYLSVLRTGWYTNVFTLEVGDVENLTCSDGPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NCL174 182C/188C full-length (SEQ ID NO: 81)

KESYLEESCSTITEGYLSVLRTGWYTNVFTLEVGDVENLTCADGPSLIKTELDLTKSALRELKPVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLCMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEKGNTGFIIVIILIA

VLGSSMILVSVFIIIKKTRKPTGAPPELSGVTNNGFIPHS

NL/1/99 182C/188C full-length (SEQ ID NO: 82)

KESYLEESCSTITEGYLSVLRTGWYTNVFTLEVGDVENLTCTDGPSLIKTELDLTKSALRELKTVSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVVILVA

VLGLTMISVSIIIIIKKTRKPTGAPPELNGVTNGGFIPHS

NDL00-1 182C/188C full-length (SEQ ID NO: 83)

KESYLEESCSTITEGYLSVLRTGWYTNVFTLEVGDVENLTCADGPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN98-75 182C/188C full-length (SEQ ID NO: 84)

KESYLEESCSTITEGYLSVLRTGWYTNVFTLEVGDVENLTCTDGPSLIKTELDLTKSALRELKTVSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVIILIA

VLGLTMISVSIIIIIKKTRKPTGAPPELNGVTNGGFIPHS

-continued

NL/1/00 60C/G63C, 182C/188C full-length
(SEQ ID NO: 85)
KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN97-83 60C/G63C, 182C/188C full-length
(SEQ ID NO: 86)
KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NL/17/00 60C/G63C, 182C/188C full-length
(SEQ ID NO: 87)
KESYLEESCSTITEGYLSVLRTGWYTNVFTLEVGDVENLTCSDCPSLIKTELDLTKSALRELKTVSADQLAREEQIENPR

QSRFVLGAIALGVATAAAVTAGVAIAKTIRLESEVTAIKNALKTTNEAVSTLGNGVRVLATAVRELKDFVSKNLTRAINK

NKCDIDDLCMAVSFSQFNRRFLNVVRQFSDNAGITPAISLDLMTDAELARAVSNMPTSAGQIKLMLENRAMVRRKGFGIL

IGVYGSSVIYTVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPIKFPEDQFNVALDQVFENIENSQALVDQSNRILSSAEKGNTGFIIVIILIA

VLGSSMILVSIFIIIKKTKKPTGAPPELSGVTNNGFIPHS

NCL174 60C/G63C, 182C/188C full-length
(SEQ ID NO: 88)
KESYLEESCSTITEGYLSVLRTGWYTNVFTLEVGDVENLTCADCPSLIKTELDLTKSALRELKPVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIDDLCMAVSFSQFNRRFLNVVRQFSDNAGITPAISLDLMTDAELARAVSNMPTAAGQIKLMLENRAMVRRKGFGIL

IGVYGSSVIYMVQLPIFGVIDTPCWIVKAAPSCSEKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFENIENSQALVDQSNRILSSAEKGNTGFIIVIILIA

VLGSSMILVSVFIIIKKTRKPTGAPPELSGVTNNGFIPHS

NL/1/99 60C/G63C, 182C/188C full-length
(SEQ ID NO: 89)
KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKQTNEAVSTLGNGVRVLATAVRELKEFVSKNLTSAINR

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKNGNYACLLREDQGWYCKNAGSTVYYPNEKDCETRGDHVFCDTAA

GINVAEQSRECNINISTTNYPCKVSTGRHPISMVALSPLGALVACYKGVSCSIGSNWVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVVILVA

VLGLTMISVSIIIIIKKTRKPTGAPPELNGVTNGGFIPHS

-continued

NDL00-1 60C/G63C, 182C/188C full-length (SEQ ID NO: 90)

KESYLEESCSTITEGYLSVLRTGWYTNVFTLEVGDVENLTCADCPSLIKTELDLTKSALRELRTVSADQLAREEQIENPR

QSRFVLGAIALGVATAAAVTAGVAIAKTIRLESEVTAIKNALKKTNEAVSTLGNGVRVLATAVRELKDFVSKNLTRAINK

NKCDIADLCMAVSFSQFNRRFLNVVRQFSDNAGITPAISLDLMTDAELARAVSNMPTSAGQIKLMLENRAMVRRKGFGFL

IGVYGSSVIYMVQLPIFGVIDTPCWIVKAAPSCSGKKGNYACLLREDQGWYCQNAGSTVYYPNEKDCETRGDHVFCDTAA

GINVAEQSKECNINISTTNYPCKVSTGRHPISMVALSPLGALVACYKGVSCSIGSNRVGIIKQLNKGCSYITNQDADTVT

IDNTVYQLSKVEGEQHVIKGRPVSSSFDPVKFPEDQFNVALDQVFESIENSQALVDQSNRILSSAEKGNTGFIIVIILIA

VLGSTMILVSVFIIIKKTKKPTGAPPELSGVTNNGFIPHN

CAN98-75 60C/G63C, 182C/188C full-length (SEQ ID NO: 91)

KESYLEESCSTITEGYLSVLRTGWYTNVFTLEVGDVENLTCTDCPSLIKTELDLTKSALRELKTVSADQLAREEQIENPR

QSRFVLGAIALGVATAAAVTAGIAIAKTIRLESEVNAIKGALKTTNEAVSTLGNGVRVLATAVRELKEFVSKNLTSAINK

NKCDIADLCMAVSFSQFNRRFLNVVRQFSDNAGITPAISLDLMTDAELARAVSYMPTSAGQIKLMLENRAMVRRKGFGIL

IGVYGSSVIYMVQLPIFGVIDTPCWIIKAAPSCSEKDGNYACLLREDQGWYCKNAGSTVYYPNKKDCETRGDHVFCDTAA

GINVAEQSRECNINISTTNYPCKVSTGRHPISMVALSPLGALVACYKGVSCSIGSNRVGIIKQLPKGCSYITNQDADTVT

IDNTVYQLSKVEGEQHVIKGRPVSSSFDPIKFPEDQFNVALDQVFESIENSQALVDQSNKILNSAEKGNTGFIIVIILIA

VLGLTMISVSIIIIKKTRKPTGAPPELNGVTNGGFIPHS

III. Protein Nanoparticles

In some embodiments a protein nanoparticle (such as a self-assembling protein nanoparticle) is provided that includes a recombinant HMPV F ectodomain trimer. Non-limiting example of self-assembling protein nanoparticles include ferritin nanoparticles, encapsulin nanoparticles, Sulfur Oxygenase Reductase (SOR) nanoparticles, and lumazine synthase nanoparticles, which are comprised of an assembly of monomeric subunits including ferritin proteins, encapsulin proteins, SOR proteins, and lumazine synthase, respectively. Additional protein nanoparticle structures are described by Heinze et al., J Phys Chem B., 120(26):5945-52, 2016; Hsia et al., Nature, 535(7610):136-9, 2016; and King et al., Nature, 510(7503):103-8, 2014; each of which is incorporated by reference herein.

In several embodiments, to construct such protein nanoparticles a protomer of the HMPV F ectodomain trimer can be linked to a subunit of the protein nanoparticle (such as a ferritin protein, an encapsulin protein, a SOR protein, or a lumazine synthase protein) and expressed in cells under appropriate conditions. The fusion protein self-assembles into a nanoparticle any can be purified.

In some embodiments, the HMPV F ectodomain trimer is included in a self-assembling protein nanocage that directs its own release from cells inside small vesicles in a manner that resembles viruses, for example, as described in Votteler et al., "Designed proteins induce the formation of nanocage-containing extracellular vesicles," Nature 540, 292-29, 2016. This hybrid biomaterial can fuse its membranes with target cells and deliver its contents, thereby transferring cargoes from one cell to another.

In some embodiments, the isopeptide bond conjugation system referred to as the SpyTag:SpyCatcher system is used to display antigens on nanoparticle surface, for example, by including the spytag on the recombinant HMPV F ectodomain trimer as described herein, and the spycatcher on the nanoparticle structure.

In some embodiments, a protomer of a disclosed recombinant HMPV F ectodomain trimer can be linked to a ferritin subunit to construct a ferritin nanoparticle. Ferritin nanoparticles and their use for immunization purposes (e.g., for immunization against influenza antigens) have been disclosed in the art (see, e.g., Kanekiyo et al., Nature, 499:102-106, 2013, incorporated by reference herein in its entirety). Ferritin is a globular protein that is found in all animals, bacteria, and plants, and which acts primarily to control the rate and location of polynuclear $Fe(III)_2O_3$ formation through the transportation of hydrated iron ions and protons to and from a mineralized core. The globular form of the ferritin nanoparticle is made up of monomeric subunits, which are polypeptides having a molecule weight of approximately 17-20 kDa. An example of the amino acid sequence of one such monomeric ferritin subunit is represented by:

(SEQ ID NO: 103)

ESQVRQQFSKDIEKLLNEQVNKEMQSSNLYMSMSSWCYTHSLDGAGLFLF

DHAAEEYEHAKKLIIFLNENNVPVQLTSISAPEHKFEGLTQIFQKAYEHE

QHISESINNIVDHAIKSKDHATFNFLQWYVAEQHEEEVLFKDILDKIELI

GNENHGLYLADQYVKGIAKSRKS

Each monomeric subunit has the topology of a helix bundle which includes a four antiparallel helix motif, with a fifth shorter helix (the c-terminal helix) lying roughly perpendicular to the long axis of the 4 helix bundle. According to convention, the helices are labeled 'A, B, C, D & E' from the N-terminus respectively. The N-terminal sequence lies adjacent to the capsid three-fold axis and extends to the surface, while the E helices pack together at the four-fold axis with the C-terminus extending into the capsid core. The consequence of this packing creates two pores on the capsid surface. It is expected that one or both of these pores represent the point by which the hydrated iron diffuses into and out of the capsid. Following production, these monomeric subunit proteins self-assemble into the globular ferritin protein. Thus, the globular form of ferritin comprises 24 monomeric, subunit proteins, and has a capsid-like structure having 432 symmetry. Methods of constructing ferritin nanoparticles are known to the person of ordinary skill in the art and are further described herein (see, e.g., Zhang, *Int. J. Mol. Sci.*, 12:5406-5421, 2011, which is incorporated herein by reference in its entirety).

In specific examples, the ferritin polypeptide is *E. coli* ferritin, *Helicobacter pylori* ferritin, human light chain ferritin, bullfrog ferritin or a hybrid thereof, such as *E. coli*-human hybrid ferritin, *E. coli*-bullfrog hybrid ferritin, or human-bullfrog hybrid ferritin. Exemplary amino acid sequences of ferritin polypeptides and nucleic acid sequences encoding ferritin polypeptides for use to make a ferritin nanoparticle including a recombinant HMPV F ectodomain can be found in GENBANK®, for example at accession numbers ZP_03085328, ZP_06990637, EJB64322.1, AAA35832, NP_000137 AAA49532, AAA49525, AAA49524 and AAA49523, which are specifically incorporated by reference herein in their entirety as available Apr. 10, 2015. In some embodiments, a recombinant HMPV F ectodomain can be linked to a ferritin subunit including an amino acid sequence at least 80% (such as at least 85%, at least 90%, at least 95%, or at least 97%) identical to amino acid sequence set forth as SEQ ID NO: 103.

In some embodiments, a protomer of a disclosed recombinant HMPV F ectodomain trimer can be linked to a lumazine synthase subunit to construct a lumazine synthase nanoparticle. The globular form of lumazine synthase nanoparticle is made up of monomeric subunits; an example of the sequence of one such lumazine synthase subunit is provides as the amino acid sequence set forth as:

```
                                    (SEQ ID NO: 104)
MQIYEGKLTAEGLRFGIVASRFNHALVDRLVEGAIDAIVRHGGREEDITL

VRVPGSWEIPVAAGELARKEDIDAVIAIGVLIRGATPHFDYIASEVSKGL

ADLSLELRKPITFGVITADTLEQAIERAGTKHGNKGWEAALSAIEMANLF

KSLR.
```

In some embodiments, a protomer of a disclosed recombinant HMPV F ectodomain trimer can be linked to a lumazine synthase subunit including an amino acid sequence at least 80% (such as at least 85%, at least 90%, at least 95%, or at least 97%) identical to amino acid sequence set forth as SEQ ID NO: 104.

In some embodiments, a protomer of a disclosed recombinant HMPV F ectodomain trimer can be linked to an encapsulin nanoparticle subunit to construct an encapsulin nanoparticle. The globular form of the encapsulin nanoparticle is made up of monomeric subunits; an example of the sequence of one such encapsulin subunit is provides as the amino acid sequence set forth as

```
                                    (SEQ ID NO: 105)
MEFLKRSFAPLTEKQWQEIDNRAREIFKTQLYGRKFVDVEGPYGWEYAAH

PLGEVEVLSDENEVVKWGLRKSLPLIELRATFTLDLWELDNLERGKPNVD

LSSLEETVRKVAEFEDEVIFRGCEKSGVKGLLSFEERKIECGSTPKDLLE

AIVRALSIFSKDGIEGPYTLVINTDRWINFLKEEAGHYPLEKRVEECLRG
```

-continued
```
GKIITTPRIEDALVVSERGGDFKLILGQDLSIGYEDREKDAVRLFITETF

TFQVVNPEALILLKF.
```

In some embodiments, a protomer of a disclosed recombinant HMPV F ectodomain trimer can be linked to an encapsulin subunit including an amino acid sequence at least 80% (such as at least 85%, at least 90%, at least 95%, or at least 97%) identical to amino acid sequence set forth as SEQ ID NO: 105.

Encapsulin proteins are a conserved family of bacterial proteins also known as linocin-like proteins that form large protein assemblies that function as a minimal compartment to package enzymes. The encapsulin assembly is made up of monomeric subunits, which are polypeptides having a molecule weight of approximately 30 kDa. Following production, the monomeric subunits self-assemble into the globular encapsulin assembly including 60, or in some cases, 180 monomeric subunits. Methods of constructing encapsulin nanoparticles are known to the person of ordinary skill in the art, and further described herein (see, for example, Sutter et al., Nature Struct. and Mol. Biol., 15:939-947, 2008, which is incorporated by reference herein in its entirety). In specific examples, the encapsulin polypeptide is bacterial encapsulin, such as *Thermotoga* maritime or *Pyrococcus furiosus* or *Rhodococcus erythropolis* or *Myxococcus xanthus* encapsulin.

In some embodiments, a protomer of a disclosed recombinant HMPV F ectodomain trimer can be linked to a Sulfur Oxygenase Reductase (SOR) subunit to construct a recombinant SOR nanoparticle. In some embodiments, the SOR subunit can include the amino acid sequence set forth as

```
                                    (SEQ ID NO: 106)
MEFLKRSFAPLTEKQWQEIDNRAREIFKTQLYGRKFVDVEGPYGWEYAAH

PLGEVEVLSDENEVVKWGLRKSLPLIELRATFTLDLWELDNLERGKPNVD

LSSLEETVRKVAEFEDEVIFRGCEKSGVKGLLSFEERKIECGSTPKDLLE

AIVRALSIFSKDGIEGPYTLVINTDRWINFLKEEAGHYPLEKRVEECLRG

GKIITTPRIEDALVVSERGGDFKLILGQDLSIGYEDREKDAVRLFITETF

TFQVVNPEALILLKF.
```

In some embodiments, a protomer of a disclosed recombinant HMPV F ectodomain trimer can be linked to a SOR subunit including an amino acid sequence at least 80% (such as at least 85%, at least 90%, at least 95%, or at least 97%) identical to amino acid sequence set forth as SEQ ID NO: 106.

SOR proteins are microbial proteins (for example from the thermoacidophilic archaeon Acidianus ambivalens that form 24 subunit protein assemblies. Methods of constructing SOR nanoparticles are known to the person of ordinary skill in the art (see, e.g., Urich et al., Science, 311:996-1000, 2006, which is incorporated by reference herein in its entirety). An example of an amino acid sequence of a SOR protein for use to make SOR nanoparticles is set forth in Urich et al., Science, 311:996-1000, 2006, which is incorporated by reference herein in its entirety.

For production purposes, the recombinant HMPV F ectodomain linked to the nanoparticle subunit can include an N-terminal signal peptide that is cleaved during cellular processing. For example, the recombinant HMPV F ectodomain protomer linked to the protein nanoparticle subunit can include a signal peptide at its N-terminus including, for example, a native coronavirus S signal peptide The protein nanoparticles can be expressed in appropriate cells (e.g., HEK 293 Freestyle cells) and fusion proteins are secreted from the cells self-assembled into nanoparticles. The nanoparticles can be purified using known techniques, for example by a few different chromatography procedures, e.g. Mono Q (anion exchange) followed by size exclusion (SUPEROSE® 6) chromatography.

Several embodiments include a monomeric subunit of a ferritin, encapsulin, SOR, or lumazine synthase protein, or any portion thereof which is capable of directing self-assembly of monomeric subunits into the globular form of the protein. Amino acid sequences from monomeric subunits of any known ferritin, encapsulin, SOR, or lumazine synthase protein can be used to produce fusion proteins with the recombinant HMPV F ectodomain or immunogenic fragment thereof, so long as the monomeric subunit is capable of self-assembling into a nanoparticle displaying the recombinant HMPV F ectodomain or immunogenic fragment thereof on its surface.

The fusion proteins need not comprise the full-length sequence of a monomeric subunit polypeptide of a ferritin, encapsulin, SOR, or lumazine synthase protein. Portions, or regions, of the monomeric subunit polypeptide can be utilized so long as the portion comprises amino acid sequences that direct self-assembly of monomeric subunits into the globular form of the protein.

IV. Polynucleotides and Expression

Polynucleotides encoding a protomer of any of the disclosed recombinant F ectodomain trimers are also provided. These polynucleotides include DNA, cDNA and RNA sequences which encode the protomer, as well as vectors including the DNA, cDNA and RNA sequences, such as a DNA or RNA vector used for immunization. The genetic code to construct a variety of functionally equivalent nucleic acids, such as nucleic acids which differ in sequence but which encode the same protein sequence, or encode a conjugate or fusion protein including the nucleic acid sequence.

In several embodiments, the nucleic acid molecule encodes a precursor of the protomer, that, when expressed in an appropriate cell, is processed into a disclosed HMPV F ectodomain protomer that can self-assemble into the corresponding recombinant HMPV F ectodomain trimer. For example, the nucleic acid molecule can encode a recombinant HMPV F ectodomain including a N-terminal signal sequence for entry into the cellular secretory system that is proteolytically cleaved in the during processing of the recombinant HMPV F ectodomain in the cell.

In several embodiments, the nucleic acid molecule encodes a precursor HMPV F polypeptide that, when expressed in an appropriate cell, is processed into a disclosed recombinant HMPV F ectodomain protomer including F1 and F2 polypeptides, wherein the recombinant HMPV F ectodomain protomer includes any of the appropriate stabilizing modifications described herein, and optionally can be linked to a trimerization domain, such as a T4 Fibritin trimerization domain.

In some embodiments, the nucleic acid molecule encodes a $F_0$ polypeptide that, when expressed in an appropriate cell, is processed into a protomer of the HMPV F ectodomain trimer that includes any of the prefusion or postfusion stabilizing modifications described herein, and optionally can be linked to a trimerization domain, such as a GCN4 trimerization domain and/or a T4 fibritin trimerization domain.

In some embodiments, the nucleic acid molecule encodes a full-length $F_0$ polypeptide that, when expressed in an appropriate cell, is processed into a protomer of the HMPV F ectodomain trimer wherein protomer includes any of the prefusion-stabilizing modifications described herein and comprises a transmembrane domain and cytoplasmic tail.

Exemplary nucleic acids can be prepared by cloning techniques. Examples of appropriate cloning and sequencing techniques, and instructions sufficient to direct persons of skill through many cloning exercises are known (see, e.g., Sambrook et al. (Molecular Cloning: A Laboratory Manual, $4^{th}$ ed, Cold Spring Harbor, New York, 2012) and Ausubel et al. (In Current Protocols in Molecular Biology, John Wiley & Sons, New York, through supplement 104, 2013).

Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill.

The polynucleotides encoding a disclosed recombinant HMPV F ectodomain protomer can include a recombinant DNA which is incorporated into a vector (such as an expression vector) into an autonomously replicating plasmid or virus or into the genomic DNA of a prokaryote or eukaryote, or which exists as a separate molecule (such as a cDNA) independent of other sequences. The nucleotides can be ribonucleotides, deoxyribonucleotides, or modified forms of either nucleotide. The term includes single and double forms of DNA.

Polynucleotide sequences encoding a disclosed recombinant HMPV F ectodomain protomer can be operatively linked to expression control sequences. An expression control sequence operatively linked to a coding sequence is ligated such that expression of the coding sequence is achieved under conditions compatible with the expression control sequences. The expression control sequences include, but are not limited to, appropriate promoters, enhancers, transcription terminators, a start codon (i.e., ATG) in front of a protein-encoding gene, splicing signal for introns, maintenance of the correct reading frame of that gene to permit proper translation of mRNA, and stop codons.

DNA sequences encoding the disclosed recombinant F ectodomain protomer can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art.

Hosts can include microbial, yeast, insect and mammalian organisms. Methods of expressing DNA sequences having eukaryotic or viral sequences in prokaryotes are well known in the art. Non-limiting examples of suitable host cells include bacteria, archea, insect, fungi (for example, yeast), plant, and animal cells (for example, mammalian cells, such as human). Exemplary cells of use include *Escherichia coli, Bacillus subtilis, Saccharomyces cerevisiae, Salmonella typhimurium*, SF9 cells, C129 cells, 293 cells, *Neurospora*, and immortalized mammalian myeloid and lymphoid cell lines. Techniques for the propagation of mammalian cells in culture are well-known (see, e.g., Helgason and Miller (Eds.), 2012, Basic Cell Culture Protocols (Methods in Molecular Biology), $4^{th}$ Ed., Humana Press). Examples of commonly used mammalian host cell lines are VERO and HeLa cells, CHO cells, and W138, BHK, and COS cell lines, although cell lines may be used, such as cells designed to provide higher expression, desirable glycosylation patterns, or other features. In some embodiments, the host cells include HEK293 cells or derivatives thereof, such as GnTI$^{-/-}$ cells (ATCC® No. CRL-3022), or HEK-293F cells.

Transformation of a host cell with recombinant DNA can be carried out by conventional techniques. Where the host is prokaryotic, such as, but not limited to, *E. coli*, competent cells which are capable of DNA uptake can be prepared from cells harvested after exponential growth phase and subsequently treated by the $CaCl_2$ method using standard procedures. Alternatively, $MgCl_2$ or RbCl can be used. Transformation can also be performed after forming a protoplast of the host cell if desired, or by electroporation.

When the host is a eukaryote, such methods of transfection of DNA as calcium phosphate coprecipitates, conventional mechanical procedures such as microinjection, electroporation, insertion of a plasmid encased in liposomes, or viral vectors can be used. Eukaryotic cells can also be co-transformed with polynucleotide sequences encoding a disclosed antigen, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, Viral Expression Vectors, Springer press, Muzyczka ed., 2011). Appropriate expression systems such as plasmids and vectors of use in producing proteins in cells including higher eukaryotic cells such as the COS, CHO, HeLa and myeloma cell lines.

In one non-limiting example, a disclosed immunogen is expressed using the pVRC8400 vector (described in Barouch et al., *J. Virol.*, 79, 8828-8834, 2005, which is incorporated by reference herein).

Modifications can be made to a nucleic acid encoding a disclosed recombinant HMPV F ectodomain protomer without diminishing its biological activity. Some modifications can be made to facilitate the cloning, expression, or incorporation of the targeting molecule into a fusion protein. Such modifications are well known to those of skill in the art and include, for example, termination codons, a methionine added at the amino terminus to provide an initiation, site, additional amino acids placed on either terminus to create conveniently located restriction sites, or additional amino acids (such as poly His) to aid in purification steps.

In some embodiments, the disclosed recombinant HMPV F ectodomain protomer can be expressed in cells under conditions where the recombinant HMPV F ectodomain protomer can self-assemble into trimers which are secreted from the cells into the cell media. In such embodiments, each recombinant HMPV F ectodomain protomer contains a leader sequence (signal peptide) that causes the protein to enter the secretory system, where the signal peptide is cleaved and the protomers form a trimer, before being secreted in the cell media. The medium can be centrifuged and recombinant HMPV F ectodomain trimer purified from the supernatant.

V. Viral Vectors

A nucleic acid molecule encoding a protomer of a disclosed recombinant HMPV F ectodomain trimer can be included in a viral vector, for example, for expression of the immunogen in a host cell, or for immunization of a subject as disclosed herein. In some embodiments, the viral vectors are administered to a subject as part of a prime-boost vaccination. In several embodiments, the viral vectors are included in a vaccine, such as a primer vaccine or a booster vaccine for use in a prime-boost vaccination.

In several examples, the viral vector can be replication-competent. For example, the viral vector can have a mutation in the viral genome that does not inhibit viral replication in host cells. The viral vector also can be conditionally replication-competent. In other examples, the viral vector is replication-deficient in host cells.

In several embodiments, the viral vector can be delivered via the respiratory tract. For example, a hPIV vector, such as bovine parainfluenza virus (BPIV) vector (e.g., a BPIV1, BPIV2, or BPIV3 vector) or human hPIV vector (e.g., a hPIV3 vector), a metapneumovirus (HMPV) vector, a Sendia virus vector, a New Castle Disease Virus (NCDV (vector), a mumps virus vector, a measles virus vector, or another paramyxovirus or pneumovirus vector is used to express a disclosed antigen.

A number of viral vectors have been constructed, that can be used to express the disclosed antigens, including polyoma, i.e., SV40 (Madzak et al., 1992, *J. Gen. Virol.*, 73:15331536), adenovirus (Berkner, 1992, *Cur. Top. Microbiol. Immunol.*, 158:39-6; Berliner et al., 1988, *Bio Techniques*, 6:616-629; Gorziglia et al., 1992, *J. Virol.*, 66:4407-4412; Quantin et al., 1992, *Proc. Natl. Acad. Sci. USA*, 89:2581-2584; Rosenfeld et al., 1992, *Cell*, 68:143-155; Wilkinson et al., 1992, *Nucl. Acids Res.*, 20:2233-2239; Stratford-Perricaudet et al., 1990, *Hum. Gene Ther.*, 1:241-256), vaccinia virus (Mackett et al., 1992, *Biotechnology*, 24:495-499), adeno-associated virus (Muzyczka, 1992, *Curr. Top. Microbiol. Immunol.*, 158:91-123; On et al., 1990, *Gene*, 89:279-282), herpes viruses including HSV and EBV (Margolskee, 1992, *Curr. Top. Microbiol. Immunol.*, 158: 67-90; Johnson et al., 1992, *J. Virol.*, 66:29522965; Fink et al., 1992, *Hum. Gene Ther.* 3:11-19; Breakfield et al., 1987, *Mol. Neurobiol.*, 1:337-371; Fresse et al., 1990, *Biochem. Pharmacol.*, 40:2189-2199), Sindbis viruses (H. Herweijer et al., 1995, *Human Gene Therapy* 6:1161-1167; U.S. Pat. Nos. 5,091,309 and 5,2217,879), alphaviruses (S. Schlesinger, 1993, *Trends Biotechnol.* 11:18-22; I. Frolov et al., 1996, *Proc. Natl. Acad. Sci. USA* 93:11371-11377) and retroviruses of avian (Brandyopadhyay et al., 1984, *Mol. Cell Biol.*, 4:749-754; Petropouplos et al., 1992, *J. Virol.*, 66:3391-3397), murine (Miller, 1992, *Curr. Top. Microbiol. Immunol.*, 158:1-24; Miller et al., 1985, *Mol. Cell Biol.*, 5:431-437; Sorge et al., 1984, *Mol. Cell Biol.*, 4:1730-1737; Mann et al., 1985, *J. Virol.*, 54:401-407), and human origin (Page et al., 1990, *J. Virol.*, 64:5370-5276; Buchschalcher et al., 1992, *J. Virol.*, 66:2731-2739). Baculovirus (*Autographa californica* multinuclear polyhedrosis virus; AcMNPV) vectors are also known in the art, and may be obtained from commercial sources (such as PharMingen, San Diego, Calif.; Protein Sciences Corp., Meriden, Conn.; Stratagene, La Jolla, Calif.).

In some embodiments, the viral vector can include an adenoviral vector that expresses a disclosed recombinant HMPV F protein or immunogenic fragment thereof. Adenovirus from various origins, subtypes, or mixture of subtypes can be used as the source of the viral genome for the adenoviral vector. Non-human adenovirus (e.g., simian, chimpanzee, gorilla, avian, canine, ovine, or bovine adenoviruses) can be used to generate the adenoviral vector. For example, a simian adenovirus can be used as the source of the viral genome of the adenoviral vector. A simian adeno-virus can be of serotype 1, 3, 7, 11, 16, 18, 19, 20, 27, 33, 38, 39, 48, 49, 50, or any other simian adenoviral serotype. A simian adenovirus can be referred to by using any suitable abbreviation known in the art, such as, for example, SV, SAdV, SAV or sAV. In some examples, a simian adenoviral vector is a simian adenoviral vector of serotype 3, 7, 11, 16, 18, 19, 20, 27, 33, 38, or 39. In one example, a chimpanzee serotype C Ad3 vector is used (see, e.g., Peruzzi et al., Vaccine, 27:1293-1300, 2009). Human adenovirus can be used as the source of the viral genome for the adenoviral vector. Human adenovirus can be of various subgroups or serotypes. For instance, an adenovirus can be of subgroup A (e.g., serotypes 12, 18, and 31), subgroup B (e.g., serotypes 3, 7, 11, 14, 16, 21, 34, 35, and 50), subgroup C (e.g., serotypes 1, 2, 5, and 6), subgroup D (e.g., serotypes 8, 9, 10, 13, 15, 17, 19, 20, 22, 23, 24, 25, 26, 27, 28, 29, 30, 32, 33, 36-39, and 42-48), subgroup E (e.g., serotype 4), subgroup F (e.g., serotypes 40 and 41), an unclassified serogroup (e.g., serotypes 49 and 51), or any other adenoviral serotype. The person of ordinary skill in the art is familiar with replication competent and deficient adenoviral vectors (including singly and multiply replication deficient adenoviral vectors). Examples of replication-deficient adenoviral vectors, including multiply replication-deficient adenoviral vectors, are disclosed in U.S. Pat. Nos. 5,837,511; 5,851,806; 5,994, 106; 6,127,175; 6,482,616; and 7,195,896, and International Patent Application Nos. WO 94/28152, WO 95/02697, WO 95/16772, WO 95/34671, WO 96/22378, WO 97/12986, WO 97/21826, and WO 03/02231 1.

VI. Virus-Like Particles

In some embodiments, a virus-like particle (VLP) is provided that includes a disclosed recombinant HMPV F ectodomain trimer. Typically such VLPs include a recom-binant HMPV F ectodomain trimer that is membrane anchored by a C-terminal transmembrane domain, for example the recombinant HMPV F ectodomain protomers in the trimer each can be linked to a transmembrane domain and cytosolic tail from HMPV F protein. VLPs lack the viral components that are required for virus replication and thus represent a highly attenuated, replication-incompetent form of a virus. However, the VLP can display a polypeptide (e.g., a recombinant HMPV F ectodomain trimer) that is analo-gous to that expressed on infectious virus particles and can eliciting an immune response to HMPV when administered to a subject. Virus like particles and methods of their production are known and familiar to the person of ordinary skill in the art, and viral proteins from several viruses are known to form VLPs, including human papillomavirus, HIV (Kang et al., Biol. Chem. 380: 353-64 (1999)), Semliki-Forest virus (Notka et al., Biol. Chem. 380: 341-52 (1999)), human polyomavirus (Goldmann et al., J. Virol. 73: 4465-9 (1999)), rotavirus (Jiang et al., Vaccine 17: 1005-13 (1999)), parvovirus (Casal, Biotechnology and Applied Biochemis-try, Vol 29, Part 2, pp 141-150 (1999)), canine parvovirus (Hurtado et al., J. Virol. 70: 5422-9 (1996)), hepatitis E virus (Li et al., J. Virol. 71: 7207-13 (1997)), and Newcastle disease virus. The formation of such VLPs can be detected by any suitable technique. Examples of suitable techniques known in the art for detection of VLPs in a medium include, e.g., electron microscopy techniques, dynamic light scatter-ing (DLS), selective chromatographic separation (e.g., ion exchange, hydrophobic interaction, and/or size exclusion chromatographic separation of the VLPs) and density gra-dient centrifugation.

VII. Immunogenic Compositions

Immunogenic compositions comprising a disclosed immunogen (e.g., a disclosed recombinant HMPV F ectodo-main trimer or nucleic acid molecule encoding a protomer of disclosed recombinant HMPV F ectodomain trimer) and a pharmaceutically acceptable carrier are also provided. Such pharmaceutical compositions can be administered to sub-jects by a variety of administration modes known to the person of ordinary skill in the art, for example, intramus-cular, intradermal, subcutaneous, intravenous, intra-arterial, intra-articular, intraperitoneal, intranasal, sublingual, tonsil-lar, oropharyngeal, or other parenteral and mucosal routes. In several embodiments, pharmaceutical compositions including one or more of the disclosed immunogens are immunogenic compositions. Actual methods for preparing administrable compositions will be known or apparent to those skilled in the art and are described in more detail in such publications as *Remingtons Pharmaceutical Sciences, 19th Ed.*, Mack Publishing Company, Easton, Pennsylvania, 1995.

Thus, an immunogen described herein can be formulated with pharmaceutically acceptable carriers to help retain biological activity while also promoting increased stability during storage within an acceptable temperature range. Potential carriers include, but are not limited to, physiologi-cally balanced culture medium, phosphate buffer saline solution, water, emulsions (e.g., oil/water or water/oil emul-sions), various types of wetting agents, cryoprotective addi-tives or stabilizers such as proteins, peptides or hydrolysates (e.g., albumin, gelatin), sugars (e.g., sucrose, lactose, sorbi-tol), amino acids (e.g., sodium glutamate), or other protec-tive agents. The resulting aqueous solutions may be pack-aged for use as is or lyophilized. Lyophilized preparations are combined with a sterile solution prior to administration for either single or multiple dosing.

Formulated compositions, especially liquid formulations, may contain a bacteriostat to prevent or minimize degrada-tion during storage, including but not limited to effective concentrations (usually 1% w/v) of benzyl alcohol, phenol, m-cresol, chlorobutanol, methylparaben, and/or propylpara-ben. A bacteriostat may be contraindicated for some patients; therefore, a lyophilized formulation may be recon-stituted in a solution either containing or not containing such a component.

The immunogenic compositions of the disclosure can contain as pharmaceutically acceptable vehicles substances as required to approximate physiological conditions, such as pH adjusting and buffering agents, tonicity adjusting agents, wetting agents and the like, for example, sodium acetate, sodium lactate, sodium chloride, potassium chloride, cal-cium chloride, sorbitan monolaurate, and triethanolamine oleate.

The immunogenic composition may optionally include an adjuvant to enhance an immune response of the host. Suit-able adjuvants are, for example, toll-like receptor agonists, alum, AlPO4, alhydrogel, Lipid-A and derivatives or vari-ants thereof, oil-emulsions, saponins, neutral liposomes, liposomes containing the vaccine and cytokines, non-ionic block copolymers, and chemokines. Non-ionic block poly-mers containing polyoxyethylene (POE) and polyxylpropyl-ene (POP), such as POE-POP-POE block copolymers, MPL™ (3-O-deacylated monophosphoryl lipid A; Corixa, Hamilton, IN) and IL-12 (Genetics Institute, Cambridge, MA), among many other suitable adjuvants well known in the art, may be used as an adjuvant (Newman et al., 1998, *Critical Reviews in Therapeutic Drug Carrier Systems* 15:89-142). These adjuvants have the advantage in that they help to stimulate the immune system in a non-specific way, thus enhancing the immune response to a pharmaceutical product.

In some instances, the adjuvant formulation is a mineral salt, such as a calcium or aluminum (alum) salt, for example calcium phosphate, aluminum phosphate or aluminum hydroxide. In some embodiments, the disclosed immunogen comprises one or more phosphoserine modifications and is used with an Alum adjuvant. In some embodiments, the adjuvant includes an oil and water emulsion, e.g., an oil-in-water emulsion (such as MF59 (Novartis) or AS03 (GlaxoSmithKline). One example of an oil-in-water emulsion comprises a metabolisable oil, such as squalene, a tocol such as a tocopherol, e.g., alpha-tocopherol, and a surfactant, such as sorbitan trioleate (Span 85) or polyoxyethylene sorbitan monooleate (Tween 80), in an aqueous carrier.

In some instances it may be desirable to combine a disclosed immunogen with other pharmaceutical products (e.g., vaccines) which induce protective responses to other agents. For example, a composition including a recombinant HMPV F ectodomain trimer as described herein can be can be administered simultaneously (typically separately) or sequentially with other vaccines recommended by the Advisory Committee on Immunization Practices (ACIP; cdc.gov/vaccines/acip/index.html) for the targeted age group (e.g., infants from approximately one to six months of age), such as an influenza vaccine or a varicella zoster vaccine. As such, a disclosed immunogen including a recombinant HMPV F ectodomain trimer described herein may be administered simultaneously or sequentially with vaccines against, for example, hepatitis B (HepB), diphtheria, tetanus and pertussis (DTaP), pneumococcal bacteria (PCV), *Haemophilus influenzae* type b (Hib), polio, influenza and rotavirus.

In some embodiments, the composition can be provided as a sterile composition. The pharmaceutical composition typically contains an effective amount of a disclosed immunogen and can be prepared by conventional techniques. Typically, the amount of immunogen in each dose of the immunogenic composition is selected as an amount which induces an immune response without significant, adverse side effects. In some embodiments, the composition can be provided in unit dosage form for use to induce an immune response in a subject. A unit dosage form contains a suitable single preselected dosage for administration to a subject, or suitable marked or measured multiples of two or more preselected unit dosages, and/or a metering mechanism for administering the unit dose or multiples thereof. In other embodiments, the composition further includes an adjuvant.

VIII. Methods of Inducing an Immune Response

The disclosed immunogens (e.g., recombinant HMPV F ectodomain trimer, a nucleic acid molecule (such as an RNA molecule) or vector encoding a protomer of a disclosed recombinant HMPV F ectodomain trimer, or a protein nanoparticle or virus like particle comprising a disclosed recombinant HMPV F ectodomain trimer) can be administered to a subject to induce an immune response to HMPV F protein in the subject. In a particular example, the subject is a human. The immune response can be a protective immune response, for example a response that inhibits subsequent infection with HMPV. Elicitation of the immune response can also be used to treat or inhibit HMPV infection and illnesses associated with the HMPV infection.

A subject can be selected for treatment that has or is at risk for developing HMPV infection, for example because of exposure or the possibility of exposure to the HMPV. Following administration of a disclosed immunogen, the subject can be monitored for infection or symptoms associated with HMPV infection.

Typical subjects intended for treatment with the therapeutics and methods of the present disclosure include humans, as well as non-human primates and other animals. Because nearly all humans are infected with HMPV by the age of 5, the entire birth cohort is included as a relevant population for immunization. This could be done, for example, by beginning an immunization regimen anytime from birth to 6 months of age, from 6 months of age to 5 years of age, in pregnant women (or women of child-bearing age) to protect their infants by passive transfer of antibody, family members of newborn infants or those still in utero, and subjects greater than 50 years of age.

Subjects at greatest risk of HMPV infection with severe symptoms (e.g. requiring hospitalization) include children with prematurity, bronchopulmonary dysplasia, and congenital heart disease are most susceptible to severe disease. During childhood and adulthood, disease is milder but can be associated with lower airway disease and is commonly complicated by sinusitis. Disease severity increases in the institutionalized elderly (e.g., humans over 65 years old). Severe disease also occurs in persons with severe combined immunodeficiency disease or following bone marrow or lung transplantation. (See, e.g., Edwards et al., New Eng. J. Med., 368, 633-643, 2013, which is incorporated by reference herein). Thus, these subjects can be selected for administration of the disclosed immunogens, or a nucleic acid or a viral vector encoding, expressing or including an immunogen.

The administration of a disclosed immunogen can be for prophylactic or therapeutic purpose. When provided prophylactically, the immunogen is provided in advance of any symptom, for example, in advance of infection. The prophylactic administration of the immunogen serves to prevent or ameliorate any subsequent infection. When provided therapeutically, the immunogen is provided at or after the onset of a symptom of infection, for example, after development of a symptom of HMPV infection or after diagnosis with the HMPV infection. The immunogen can thus be provided prior to the anticipated exposure to the HMPV Fo as to attenuate the anticipated severity, duration or extent of an infection and/or associated disease symptoms, after exposure or suspected exposure to the HMPV, or after the actual initiation of an infection.

The immunogens described herein, and immunogenic compositions thereof, are provided to a subject in an amount effective to induce or enhance an immune response against the HMPV F protein in the immunogen in the subject, preferably a human. The actual dosage of disclosed immunogen will vary according to factors such as the disease indication and particular status of the subject (for example, the subject's age, size, fitness, extent of symptoms, susceptibility factors, and the like), time and route of administration, other drugs or treatments being administered concurrently, as well as the specific pharmacology of the composition for eliciting the desired activity or biological response in the subject. Dosage regimens can be adjusted to provide an optimum prophylactic or therapeutic response.

An immunogenic composition including one or more of the disclosed immunogens can be used in coordinate (or prime-boost) vaccination protocols or combinatorial formulations. In certain embodiments, novel combinatorial immunogenic compositions and coordinate immunization protocols employ separate immunogens or formulations, each directed toward eliciting an anti-viral immune response, such as an immune response to HMPV F protein. Separate immunogenic compositions that elicit the anti-viral immune response can be combined in a polyvalent immunogenic composition administered to a subject in a single immunization step, or they can be administered separately (in monovalent immunogenic compositions) in a coordinate (or prime-boost) immunization protocol.

There can be several boosts, and each boost can be a different disclosed immunogen. In some examples that the boost may be the same immunogen as another boost, or the prime. The prime and boost can be administered as a single dose or multiple doses, for example two doses, three doses, four doses, five doses, six doses or more can be administered to a subject over days, weeks or months. Multiple boosts can also be given, such one to five (e.g., 1, 2, 3, 4 or 5 boosts), or more. Different dosages can be used in a series of sequential immunizations. For example, a relatively large dose in a primary immunization and then a boost with relatively smaller doses.

In some embodiments, the boost can be administered about two, about three to eight, or about four, weeks following the prime, or about several months after the prime. In some embodiments, the boost can be administered about 5, about 6, about 7, about 8, about 10, about 12, about 18, about 24, months after the prime, or more or less time after the prime. Periodic additional boosts can also be used at appropriate time points to enhance the subject's "immune memory." The adequacy of the vaccination parameters chosen, e.g., formulation, dose, regimen and the like, can be determined by taking aliquots of serum from the subject and assaying antibody titers during the course of the immunization program. In addition, the clinical condition of the subject can be monitored for the desired effect, e.g., prevention of infection or improvement in disease state (e.g., reduction in viral load). If such monitoring indicates that vaccination is sub-optimal, the subject can be boosted with an additional dose of immunogenic composition, and the vaccination parameters can be modified in a fashion expected to potentiate the immune response.

In some embodiments, the prime composition administered to the subject includes (or encodes) a recombinant HMPV F ectodomain trimer from group A, and the boost composition administered to the subject includes (or encodes) a recombinant HMPV F ectodomain trimer from group B. In some embodiments, the prime composition administered to the subject includes (or encodes) a recombinant HMPV F ectodomain trimer from group B, and the boost composition administered to the subject includes (or encodes) a recombinant HMPV F ectodomain trimer from group A.

In some embodiments, the prime-boost method can include DNA-primer and protein-boost vaccination protocol to a subject. The method can include two or more administrations of the nucleic acid molecule or the protein.

For protein therapeutics, typically, each human dose will comprise 1-1000 μg of protein, such as from about 1 μg to about 100 μg, for example, from about 1 μg to about 50 μg, such as about 1 μg, about 2 μg, about 5 μg, about 10 μg, about 15 μg, about 20 μg, about 25 μg, about 30 μg, about 40 μg, or about 50 μg.

The amount utilized in an immunogenic composition is selected based on the subject population (e.g., infant or elderly). An optimal amount for a particular composition can be ascertained by standard studies involving observation of antibody titers and other responses in subjects. It is understood that a effective amount of a disclosed immunogen, such as a disclosed recombinant HMPV F ectodomain trimer, viral vector, or nucleic acid molecule in a immunogenic composition, can include an amount that is ineffective at eliciting an immune response by administration of a single dose, but that is effective upon administration of multiple dosages, for example in a prime-boost administration protocol.

Determination of effective dosages is typically based on animal model studies followed up by human clinical trials and is guided by administration protocols that significantly reduce the occurrence or severity of targeted disease symptoms or conditions in the subject, or that induce a desired response in the subject (such as a neutralizing immune response). Suitable models in this regard include, for example, murine, rat, porcine, feline, ferret, non-human primate, and other accepted animal model subjects known in the art. Alternatively, effective dosages can be determined using in vitro models (for example, immunologic and histopathologic assays). Using such models, only ordinary calculations and adjustments are required to determine an appropriate concentration and dose to administer an effective amount of the composition (for example, amounts that are effective to elicit a desired immune response or alleviate one or more symptoms of a targeted disease).

For each particular subject, specific dosage regimens can be evaluated and adjusted over time according to the individual need and professional judgment of the person administering or supervising the administration of the immunogenic composition. The dosage and number of doses will depend on the setting, for example, in an adult or anyone primed by prior HMPV infection or immunization, a single dose may be a sufficient booster. In naïve subjects, in some examples, at least two doses would be given, for example, at least three doses. In some embodiments, an annual boost is given, for example, along with an annual influenza vaccination.

Upon administration of a disclosed immunogen of this disclosure, the immune system of the subject typically responds to the immunogenic composition by producing antibodies specific for the HMPV F ectodomain trimer included in the immunogen. Such a response signifies that an immunologically effective dose was delivered to the subject.

In some embodiments, the antibody response of a subject will be determined in the context of evaluating effective dosages/immunization protocols. In most instances it will be sufficient to assess the antibody titer in serum or plasma obtained from the subject. Decisions as to whether to administer booster inoculations and/or to change the amount of the therapeutic agent administered to the individual can be at least partially based on the antibody titer level. The antibody titer level can be based on, for example, an immunobinding assay which measures the concentration of antibodies in the serum which bind to an antigen including, for example, the recombinant HMPV F ectodomain trimer included in the immunogen.

In some embodiments, administration of an effective amount of one or more of the disclosed immunogens to a subject induces a neutralizing immune response in the subject. To assess neutralization activity, following immunization of a subject, serum can be collected from the subject at appropriate time points, frozen, and stored for neutralization testing. Methods to assay for neutralization activity include, but are not limited to, plaque reduction neutralization titer (PRNT) assays, microneutralization assays, flow cytometry based assays, single-cycle infection assays. In some embodiments, the serum neutralization activity can be assayed using a panel of HMPV pseudoviruses.

MPV infection does not need to be completely eliminated or reduced or prevented for the methods to be effective. For example, elicitation of an immune response to HMPV with one or more of the disclosed immunogens can reduce or inhibit HMPV infection by a desired amount, for example, by at least 10%, at least 20%, at least 50%, at least 60%, at least 70%, at least 80%, at least 90%, at least 95%, at least 98%, or even at least 100% (elimination or prevention of detectable infected cells), as compared to HMPV infection in the absence of the immunogen. In additional examples, HMPV replication can be reduced or inhibited by the disclosed methods. HMPV replication does not need to be completely eliminated for the method to be effective. For example, the immune response elicited using one or more of the disclosed immunogens can reduce HMPV replication by a desired amount, for example, by at least 10%, at least 20%, at least 50%, at least 60%, at least 70%, at least 80%, at least 90%, at least 95%, at least 98%, or even at least 100% (elimination or prevention of detectable HMPV replication, as compared to HMPV replication in the absence of the immune response.

In some embodiments, the disclosed immunogen is administered to the subject simultaneously with the administration of the adjuvant. In other embodiments, the disclosed immunogen is administered to the subject after the administration of the adjuvant and within a sufficient amount of time to induce the immune response.

One approach to administration of nucleic acids is direct immunization with plasmid DNA, such as with a mammalian expression plasmid. Immunization by nucleic acid constructs is well known in the art and taught, for example, in U.S. Pat. No. 5,643,578 (which describes methods of immunizing vertebrates by introducing DNA encoding a desired antigen to elicit a cell-mediated or a humoral response), and U.S. Pat. Nos. 5,593,972 and 5,817,637 (which describe operably linking a nucleic acid sequence encoding an antigen to regulatory sequences enabling expression). U.S. Pat. No. 5,880,103 describes several methods of delivery of nucleic acids encoding immunogenic peptides or other antigens to an organism. The methods include liposomal delivery of the nucleic acids (or of the synthetic peptides themselves), and immune-stimulating constructs, or ISCOMS™, negatively charged cage-like structures of 30-40 nm in size formed spontaneously on mixing cholesterol and Quil A™ (saponin). Protective immunity has been generated in a variety of experimental models of infection, including toxoplasmosis and Epstein-Barr virus-induced tumors, using ISCOMS™ as the delivery vehicle for antigens (Mowat and Donachie, Immunol. Today 12:383, 1991). Doses of antigen as low as 1 µg encapsulated in ISCOMS™ have been found to produce Class I mediated CTL responses (Takahashi et al., Nature 344:873, 1990).

In some embodiments, a plasmid DNA vaccine is used to express a disclosed immunogen in a subject. For example, a nucleic acid molecule encoding a disclosed immunogen can be administered to a subject to induce an immune response to the HMPV F protein included in the immunogen. In some embodiments, the nucleic acid molecule can be included on a plasmid vector for DNA immunization, such as the pVRC8400 vector (described in Barouch et al., J. Virol, 79, 8828-8834, 2005, which is incorporated by reference herein).

In another approach to using nucleic acids for immunization, a disclosed recombinant HMPV F ectodomain or recombinant HMPV F ectodomain trimer can be expressed by attenuated viral hosts or vectors or bacterial vectors. Recombinant vaccinia virus, adeno-associated virus (AAV), herpes virus, retrovirus, cytomegalo virus or other viral vectors can be used to express the peptide or protein, thereby eliciting a CTL response. For example, vaccinia vectors and methods useful in immunization protocols are described in U.S. Pat. No. 4,722,848. BCG (Bacillus Calmette Guerin) provides another vector for expression of the peptides (see Stover, Nature 351:456-460, 1991).

In one embodiment, a nucleic acid encoding a disclosed recombinant HMPV F ectodomain or HMPV F ectodomain trimer is introduced directly into cells. For example, the nucleic acid can be loaded onto gold microspheres by standard methods and introduced into the skin by a device such as Bio-Rad's HELIOS™ Gene Gun. The nucleic acids can be "naked," consisting of plasmids under control of a strong promoter. Typically, the DNA is injected into muscle, although it can also be injected directly into other sites. Dosages for injection are usually around 0.5 µg/kg to about 50 mg/kg, and typically are about 0.005 mg/kg to about 5 mg/kg (see, e.g., U.S. Pat. No. 5,589,466).

For example, the nucleic acid can be loaded onto gold microspheres by standard methods and introduced into the skin by a device such as Bio-Rad's HELIOS™ Gene Gun. The nucleic acids can be "naked," consisting of plasmids under control of a strong promoter. Typically, the DNA is injected into muscle, although it can also be injected directly into other sites. Dosages for injection are usually around 0.5 µg/kg to about 50 mg/kg, and typically are about 0.005 mg/kg to about 5 mg/kg (see, e.g., U.S. Pat. No. 5,589,466).

In another embodiment, an mRNA-based immunization protocol can be used to deliver a nucleic acid encoding a disclosed recombinant HMPV F ectodomain directly into cells. In some embodiments, nucleic acid-based vaccines based on mRNA may provide a potent alternative to the previously mentioned approaches. mRNA vaccines preclude safety concerns about DNA integration into the host genome and can be directly translated in the host cell cytoplasm. Moreover, the simple cell-free, in vitro synthesis of RNA avoids the manufacturing complications associated with viral vectors. Two exemplary forms of RNA-based vaccination that can be used to deliver a nucleic acid encoding a disclosed recombinant HMPV F ectodomain include conventional non-amplifying mRNA immunization (see, e.g., Petsch et al., "Protective efficacy of in vitro synthesized, specific mRNA vaccines against influenza A virus infection," Nature biotechnology, 30(12):1210-6, 2012) and self-amplifying mRNA immunization (see, e.g., Geall et al., "Nonviral delivery of self-amplifying RNA vaccines," PNAS, 109(36): 14604-14609, 2012; Magini et al., "Self-Amplifying mRNA Vaccines Expressing Multiple Conserved Influenza Antigens Confer Protection against Homologous and Heterosubtypic Viral Challenge," PLoS One, 11(8):e0161193, 2016; and Brito et al., "Self-amplifying mRNA vaccines," Adv Genet., 89:179-233, 2015).

In some embodiments, administration of an effective amount of one or more of the disclosed immunogens to a subject induces a neutralizing immune response in the subject. To assess neutralization activity, following immunization of a subject, serum can be collected from the subject at appropriate time points, frozen, and stored for neutralization testing. Methods to assay for neutralization activity include, but are not limited to, plaque reduction neutralization (PRNT) assays, microneutralization assays, flow cytometry based assays, single-cycle infection assays. In some embodiments, the serum neutralization activity can be assayed using a HMPV pseudovirus, similar to that used for SARS-CoV (Martin et al., *Vaccine* 26, 6338, 2008; Yang et al., *Nature* 428, 561, 2004; Naldini et al., *PNAS* 93, 11382, 1996; Yang et al., *PNAS* 102, 797, 2005).

VIII. Examples

The following examples are provided to illustrate particular features of certain embodiments, but the scope of the claims should not be limited to those features exemplified.

Example 1

Figure 6:
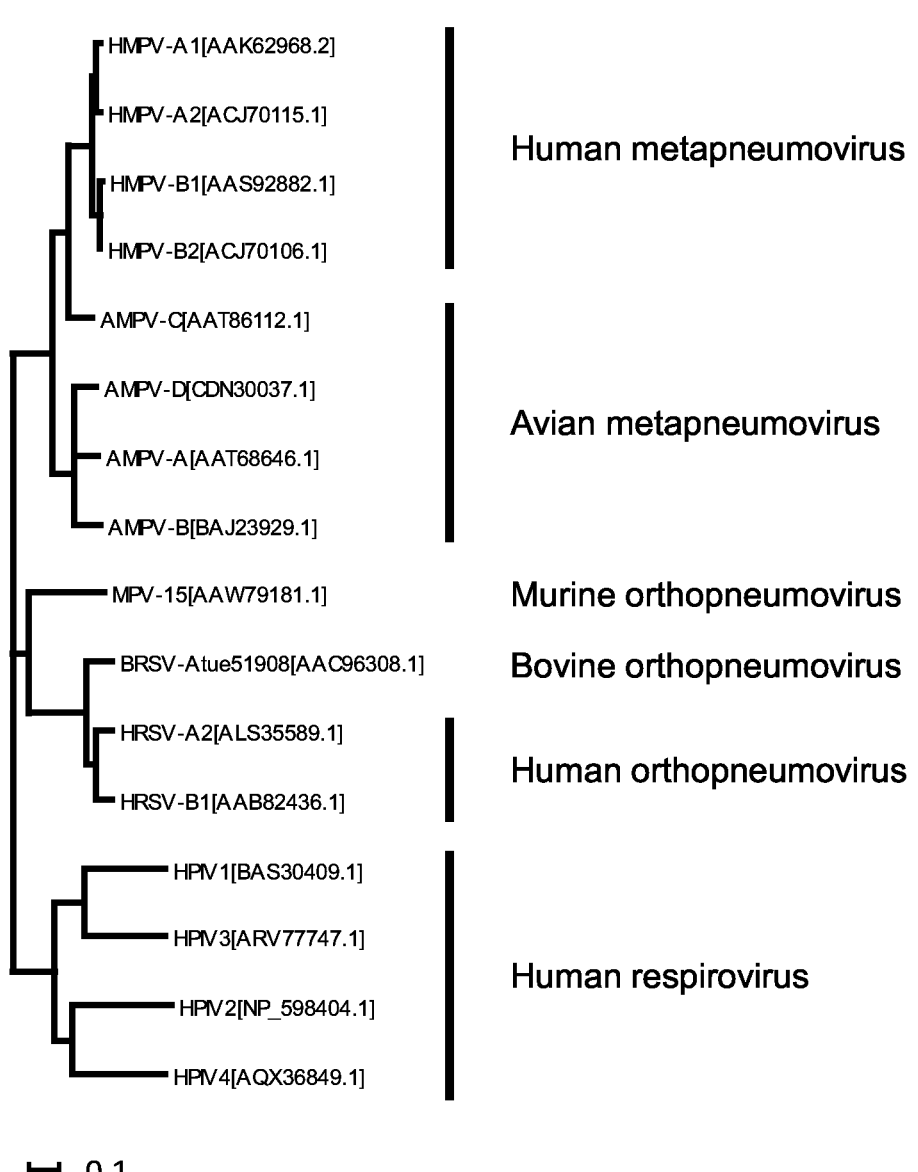
FIG. 6. Phylogenetic tree of full-length amino acids of paramyxovirus F glycoproteins. Neighbor-Joining method with evolutionary distances computed using ClustalW. The scale bar represents the number of amino acid substitutions per site. Each F protein reference sequence is labeled with its GenBank accession number.

High Titer-Neutralizing Responses Induced by Interprotomer Disulfide-Stabilization of the Fusion Glycoprotein of Human Metapneumovirus Human metapneumovirus (HMPV) is a globally widespread human respiratory pathogen, with a disease burden primarily in infants, the elderly, and the immune-compromised. Disease symptoms are similar to those of the closely related respiratory syncytial virus (RSV), with rates of hospitalization in older adults approaching those of influenza. Phylogenetic analysis (FIG. 6) shows HMPV to comprise two related subtypes, A and B, which are closely related to avian metapneumoviruses, from which HMPV might have evolved. Unfortunately, there is currently no licensed vaccine or treatment for HMPV.

This example illustrates the impact of non-native disulfide stabilization—and especially interprotomer disulfide bonds (IP-DSs)—on the elicitation of HMPV-neutralizing responses. The prefusion HMPV F structure (PDB ID 5WB0) (Battles et al., Nat Commun 8, 1528, 2017) was evaluated for sites suitable for the introduction of either intraprotomer or IP-DS bonding mutations, which were then synthesized, expressed, and tested antigenically. CryoEM structures were determined to delineate F conformation and atomic-level details of stabilization and assessed immunogenicity in mice and rhesus macaques. In mice, IP-DS-stabilized prefusion and postfusion HMPV F elicited significantly higher neutralizing responses than non-IP-DS-stabilized HMPV Fs. In macaques, IP-DS-stabilized postfusion F titers trended higher, with elicited HMPV-neutralization titers more than 10-times higher than the average titers observed in a healthy human cohort. Serological and absorption-based analyses of macaque responses revealed elicited HMPV-neutralizing responses to be absorbed differently by IP-DS-containing and by non-IP-DS-containing postfusion Fs, suggesting IP-DS stabilization to have altered not only the immunogenicity of select epitopes but their antigenicity as well. Overall, IP-DS stabilization increased neutralizing responses induced by either prefusion or postfusion forms of HMPV F, suggesting their utility in candidate vaccines.

Results

Design and characterization of intraprotomer and IP-DSs that stabilize the prefusion HMPV F trimer. Based on the prefusion structure of trimeric HMPV F, residues with appropriate distances for disulfide bond formation either within a protomer (intraprotomer disulfides) or between protomers (IP-DS) were identified. Also the HMPV F structure was analyzed for regions that moved more than 5 Å between prefusion and postfusion conformations. Six potential disulfides, three intraprotomer (A113C to A339C; A140C to A147C; K450C to S470C) and three IP-DS (A63C to K188C; V84C to A249C; A120C to Q426C) were within disulfide bonding distance and proximal to residues that moved substantial between prefusion and postfusion conformations (FIG. 1A), suggesting that their formation would stabilize the prefusion conformation.

Figure 1B:
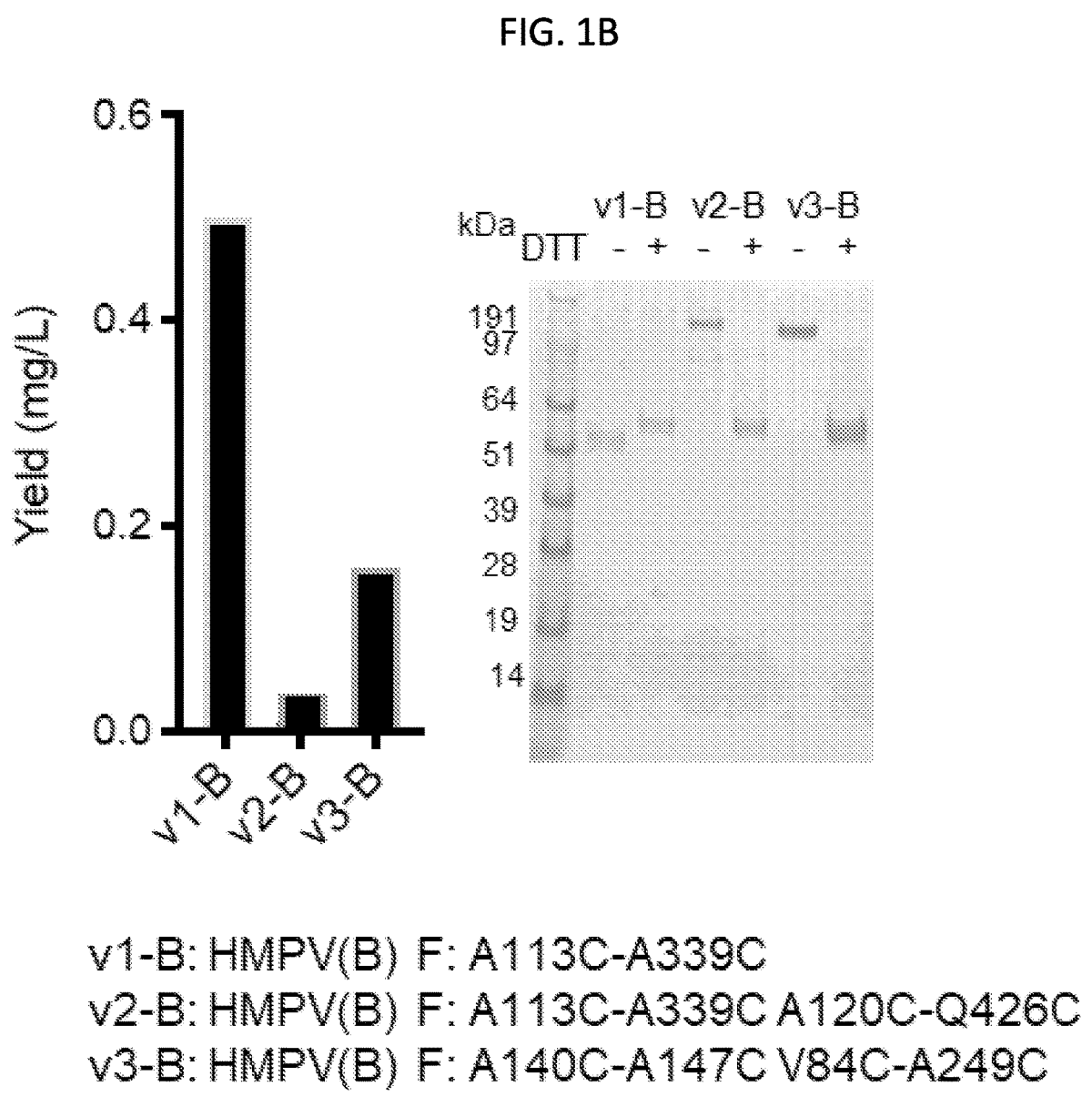
Figure 8A:
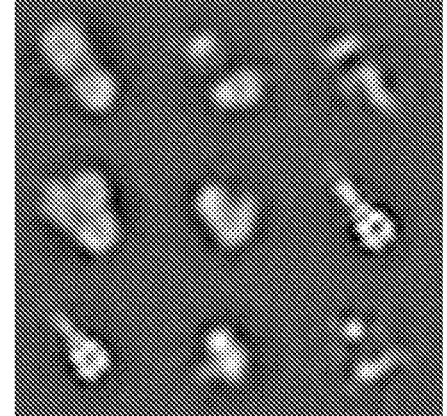
FIGS. 8A-8C. Representative negative-stain EM class averages of HMPV F variants.
Figure 8B:
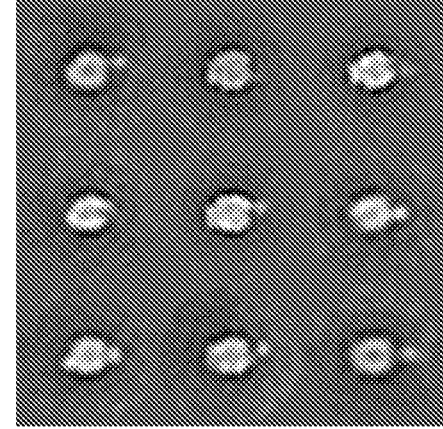
Figure 8C:
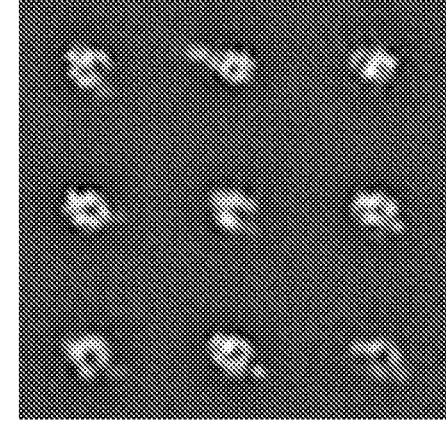

Over 100 HMPV F variants incorporating engineered disulfides were assessed. These designs often did not show favorable antigenicity, likely reflecting poor expression, but from the B2 strain CAN98-75 of HMPV, three HMPV F variants were successful: (v1-B) with a single intraprotomer disulfide 113C-339C as well as cavity-filling mutations T160F, I177L; (v2-B) with additional IP-DS 120C-426C; and (v3-B) with two disulfides, the intraprotomer 140C-147C and the IP-DS 84C-249C (FIGS. 1B and 7A,C-D). v3-B also has a substitution of HMPV positions 97-102 to GGGGGG (SEQ ID NO: 147) to remove the F1/F2 cleavage site. Expression yields were particularly low for variant v2-B where only about 0.05 mg/L was obtained by transient transfection. SDS-PAGE indicated variants with interprotomer disulfide to run as higher molecular weight species in the absence reducing reagent (FIG. 1B, right). Variants vt-B and v2-B were recognized well by the prefusion specific antibody MPE8 (Corti et al., Nature 501, 439-443, 2013), but variant v3-B was not (FIG. 7B), despite negative stain-electron micrographs showing trimeric forms that appeared to be primarily in a prefusion conformation (FIG. 8A-C).

Figure 1C:
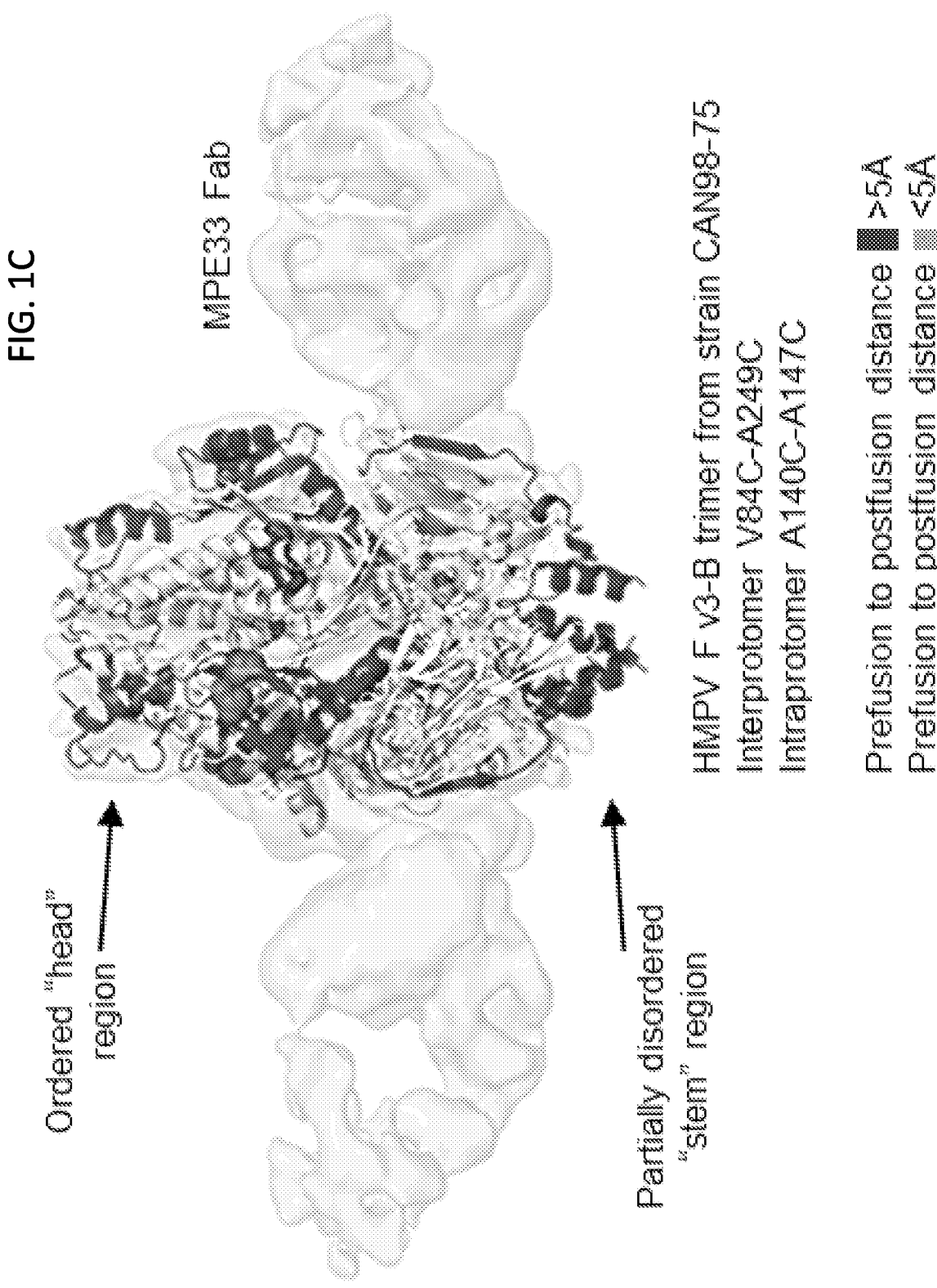
Figure 1D:
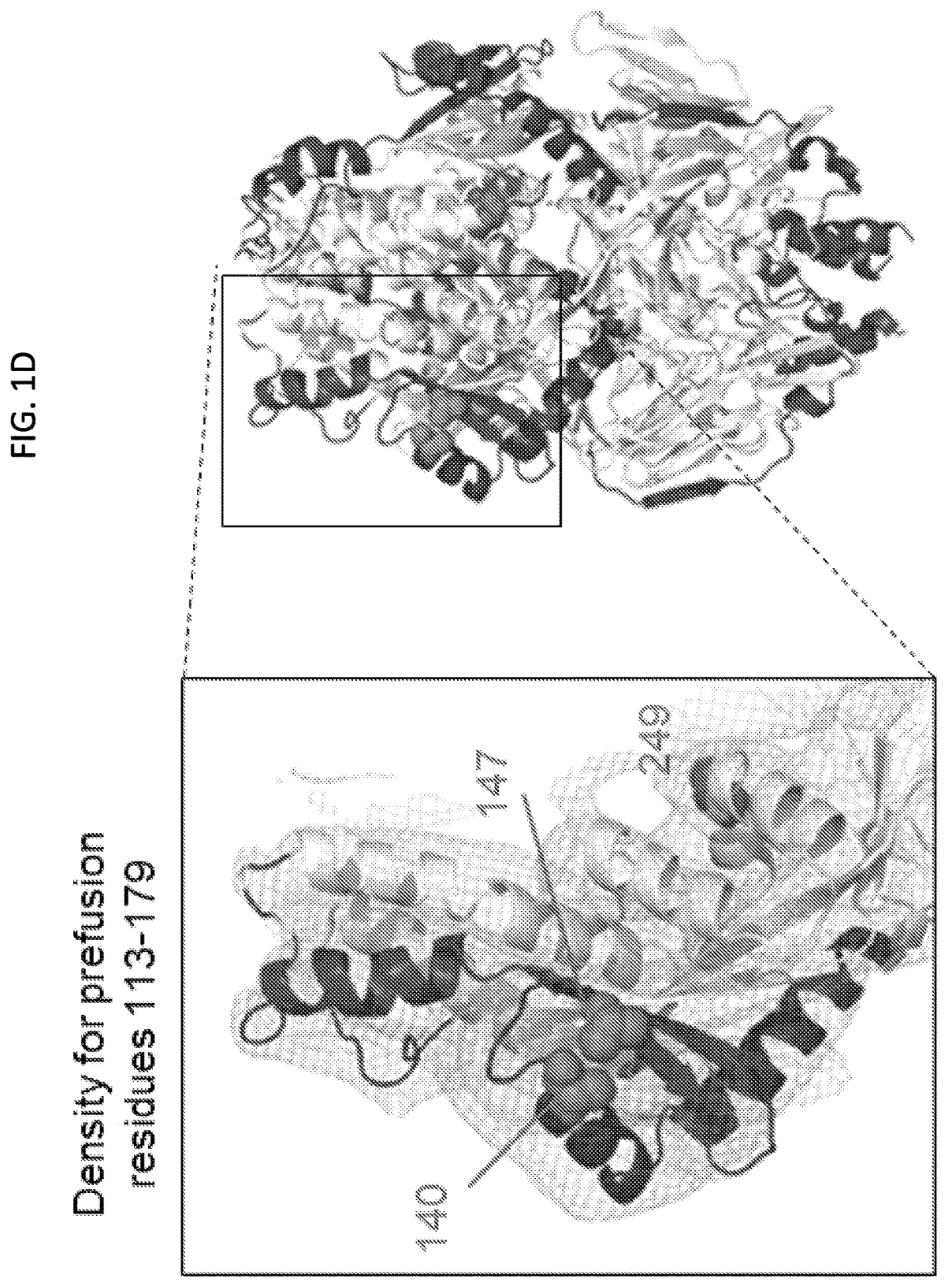
Figure 9A:
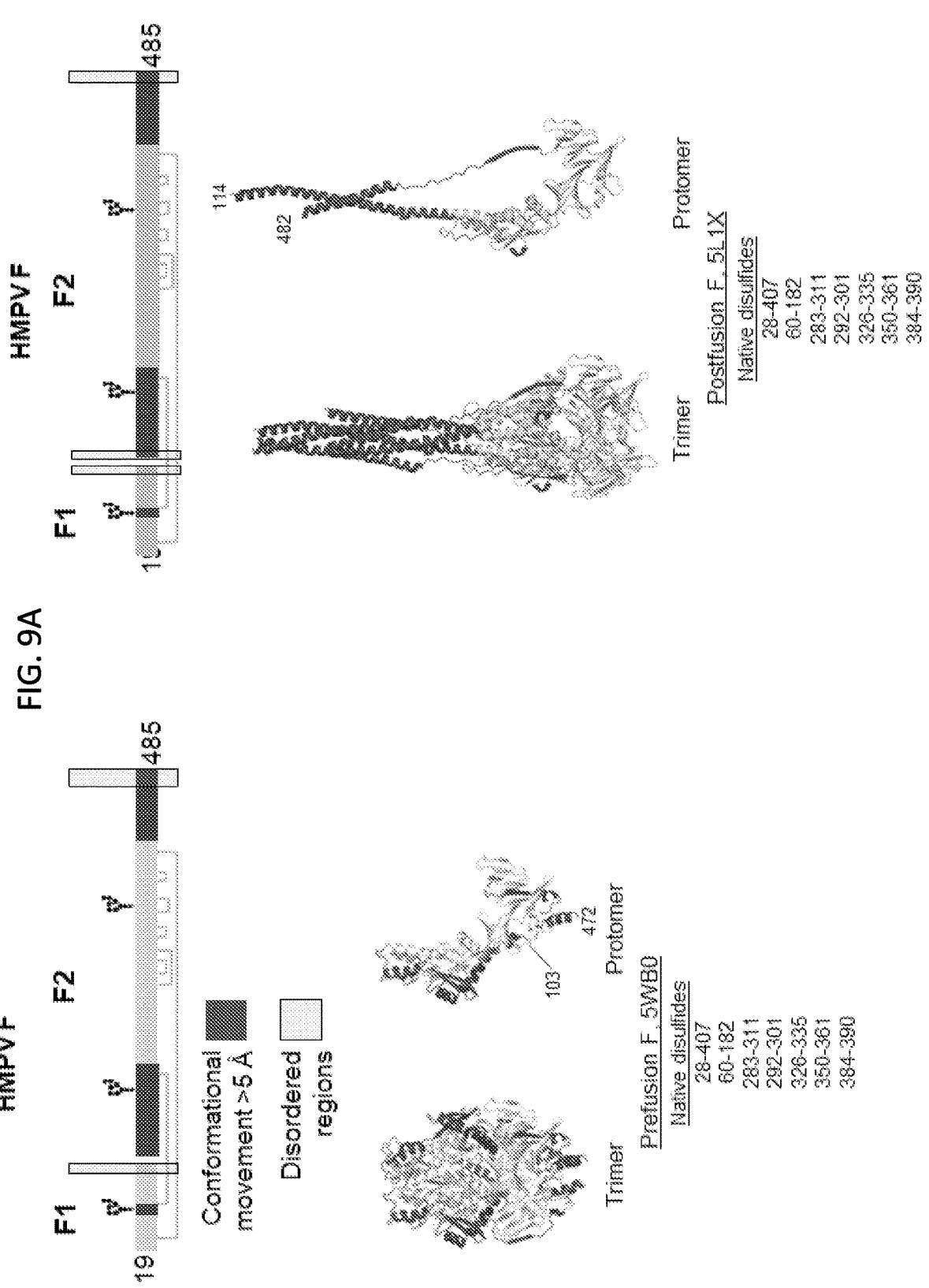
FIGS. 9A-9B.

To confirm the overall architecture of the disulfide-stabilized prefusion HMPV F, the cryo-EM structure of HMPV F v3-B in complex with antibody MPE33 was determined to 4.8 Å from 33,058 particles (FIGS. 1C, 11). The MPE33 antibody bound to a "stem" epitope about a third of the way towards the viral membrane. Reconstruction density fit well in the "head" region to the HMPV prefusion 5WB0 coordinates, but less well in the base region towards the viral membrane, consistent with a flexible or partially disordered "stem" region. The fit in the head was especially good in the 113-179 region (FIG. 1D), which changes substantially between prefusion and postfusion conformations (FIG. 9A), clearly indicating the v3-B structure to be in a prefusion conformation.

Figure 2A:
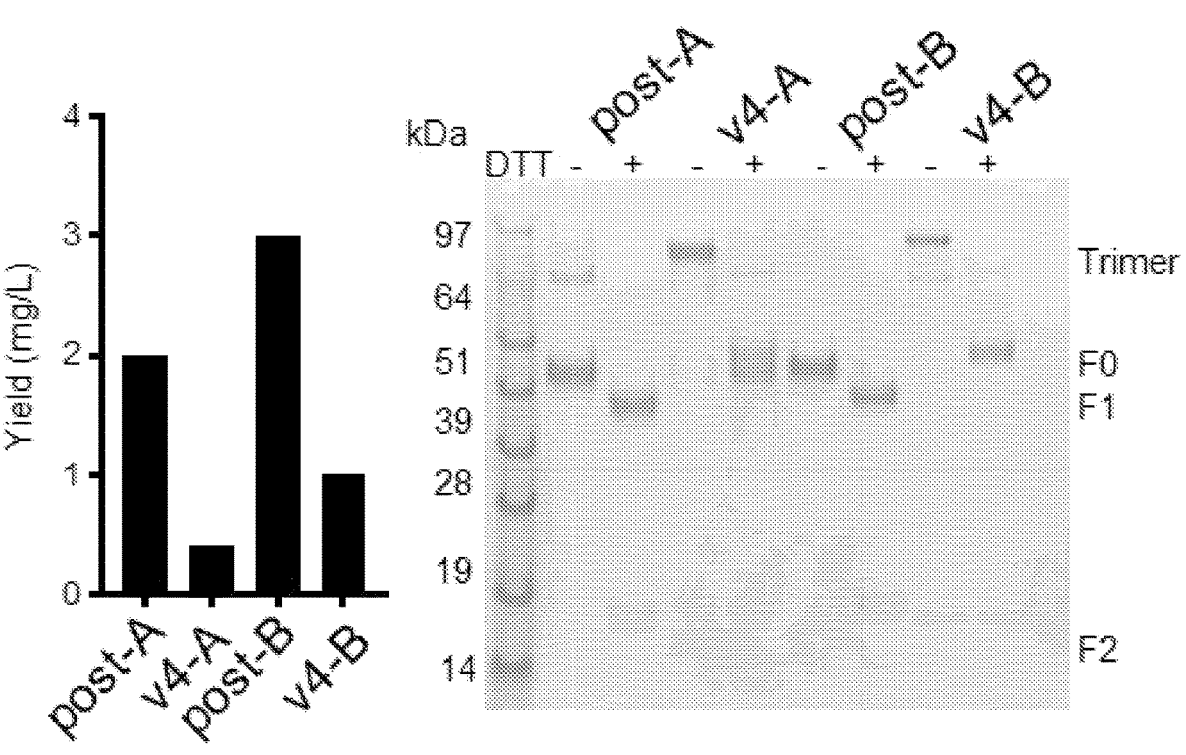
FIGS. 2A-2D. Interprotomer disulfide-based stabilization of HMPV F trimer in a postfusion state.

Characterization of an HMPV F variant with triple potential disulfides. It was observed that an HMPV F variant in both A1 strain NL/1/00 (v4-A) and B2 strain CAN98-75 (v4-B), designed with three potential disulfides between 63C-188C, 140C-147C, and 450C-470C, provided decent expression (FIG. 2A, left). By SDS-PAGE analysis, this triple-disulfide variant in both subtypes formed IP-DS, as judged by the presence of a higher molecular weight band, which appeared to correspond to a covalent-linked trimer in the absence of reducing agent (FIG. 2A, right). Antigenic analysis indicated recognition of both postfusion and triple disulfide variants by antibodies MPE33 and MPF5, though not by the prefusion-specific MPE8 (FIG. 7C). Negative stain-electron micrographs of variants v4-A and v4-B showed this variant to not fit into either the classical prefusion or postfusion forms of HMPV F (FIG. 2B), lacking a classic postfusion tail with a head region that was smaller than observed with prefusion F variants, v1-v3.

Figure 2B:
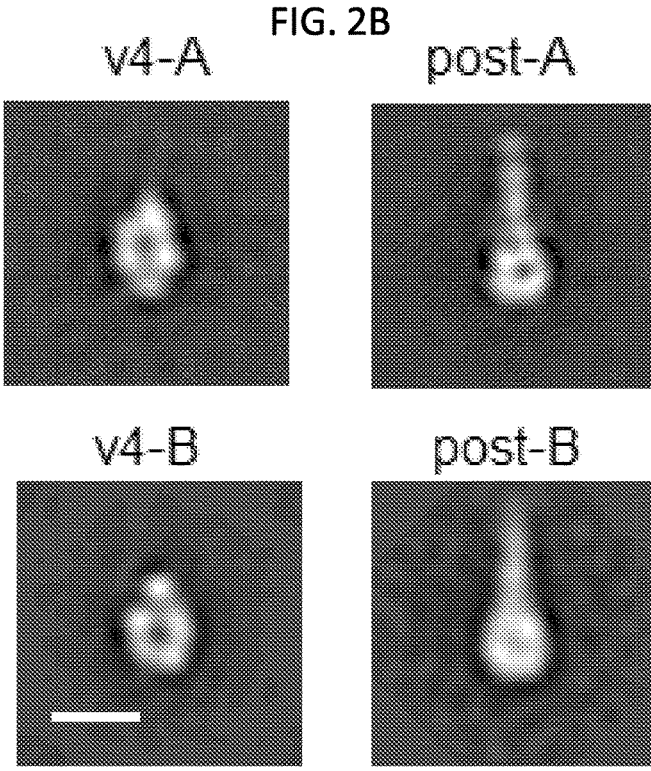
Figures 2C, 2D:
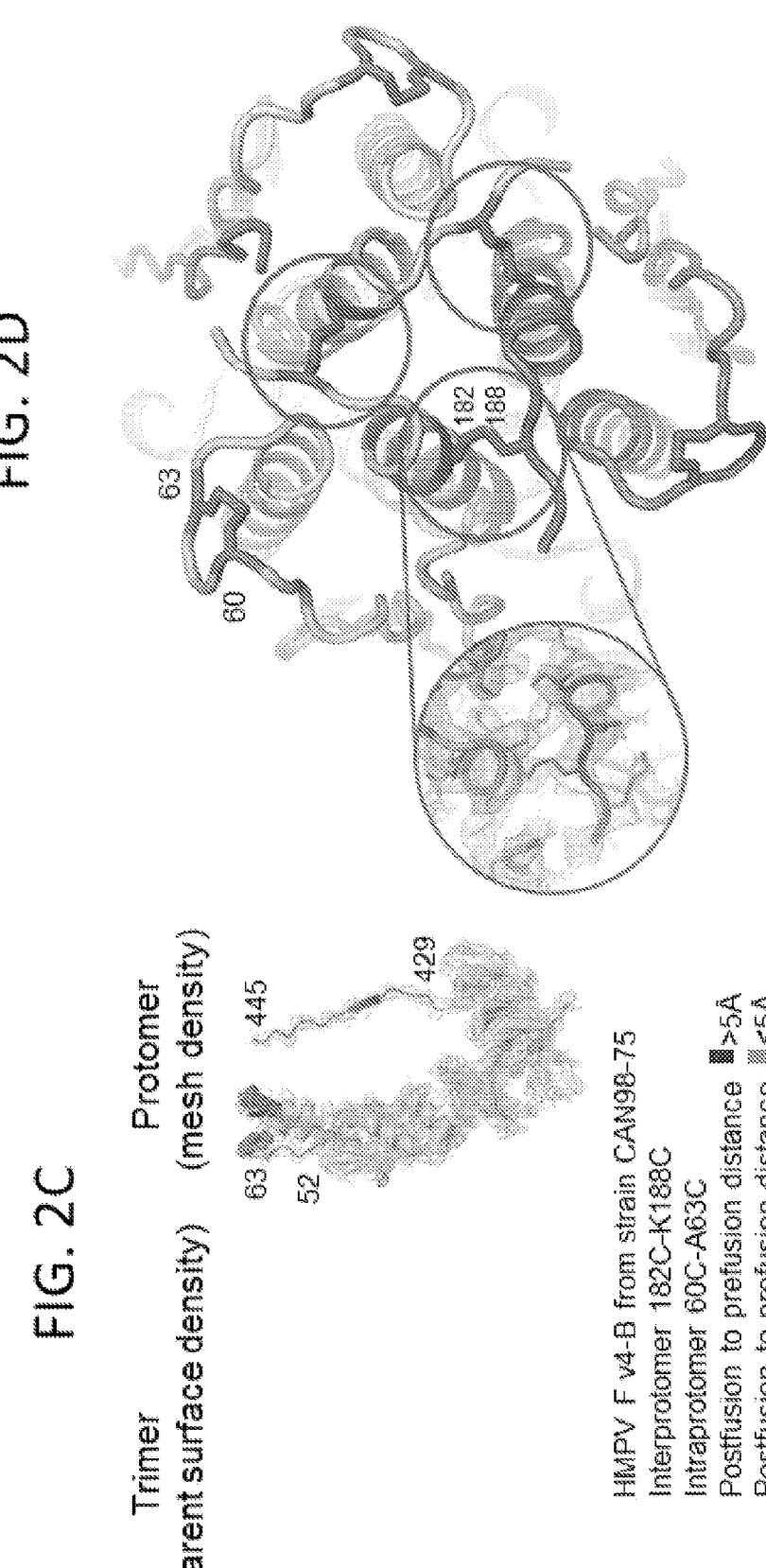
Figure 9B:
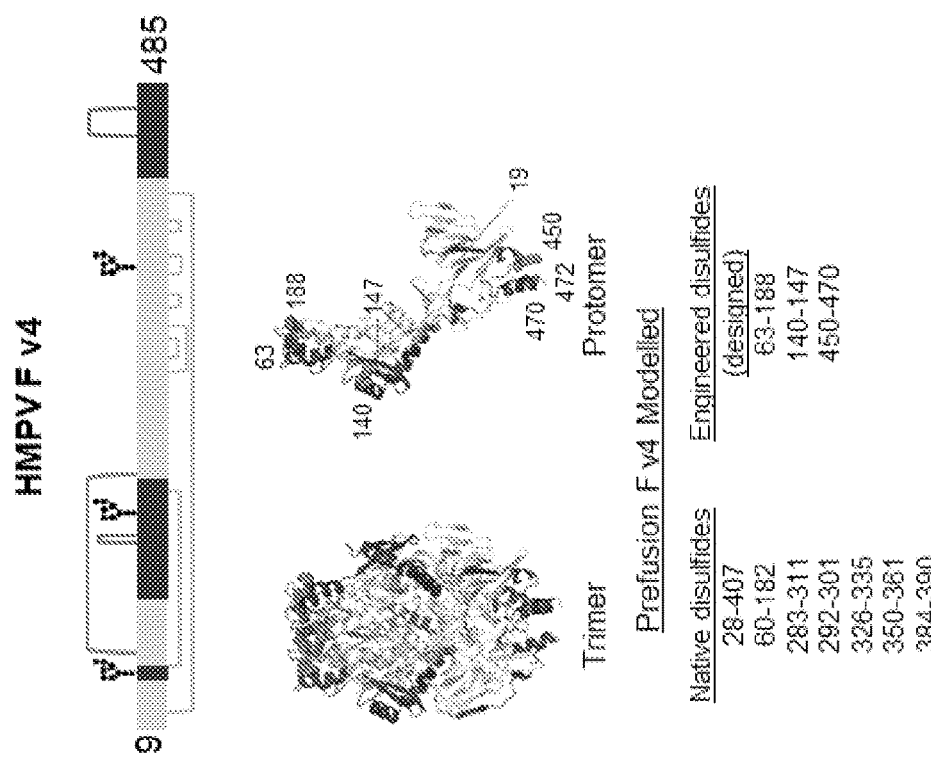
Figure 10:
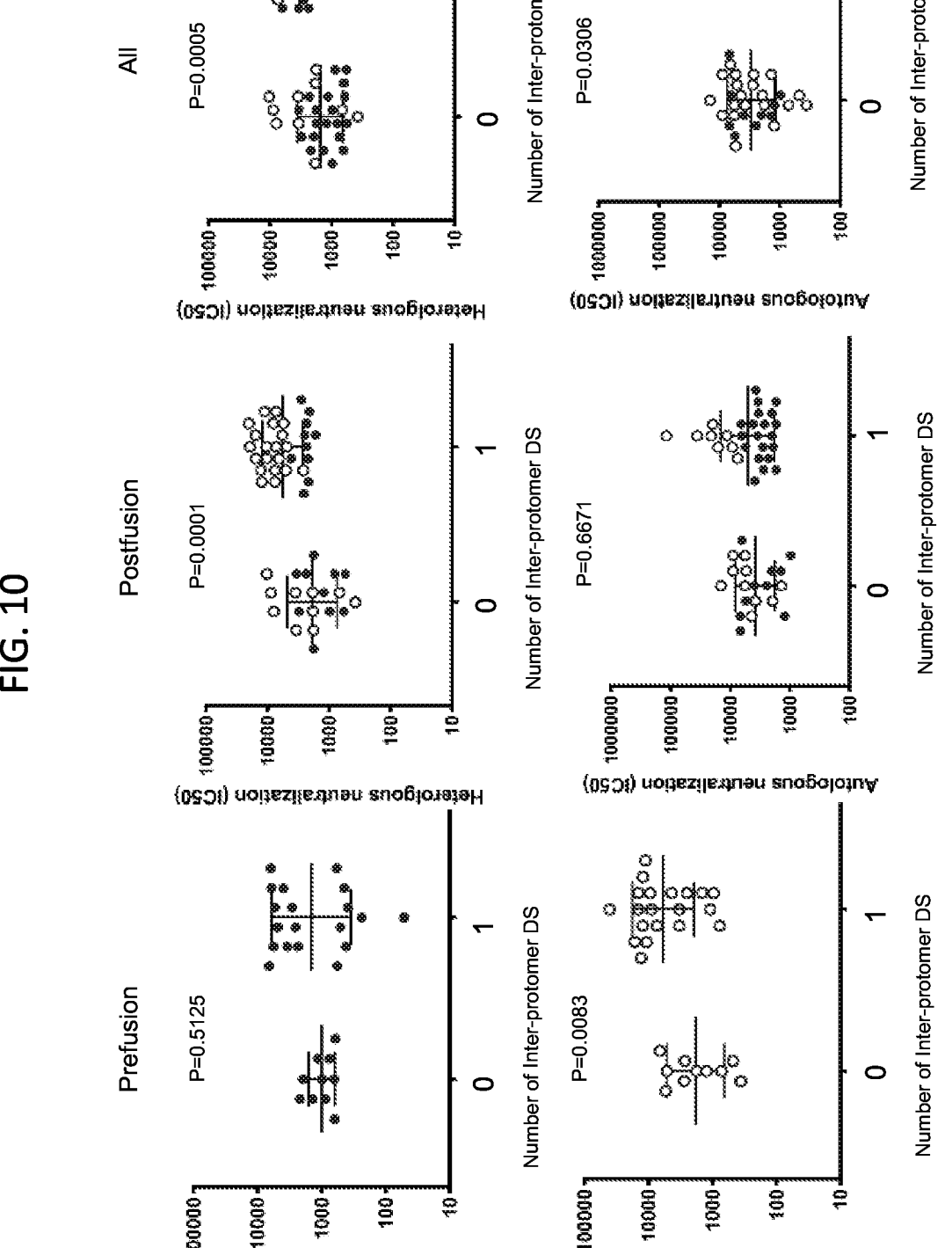
FIG. 10. Interprotomer disulfide-stabilized HMPV F variants induce high titer neutralizing responses in mice. Comparison of autologous and heterologous neutralization titers elicited by interprotomer disulfide stabilized prefusion and postfusion forms of hMPV F.
Figure 18:
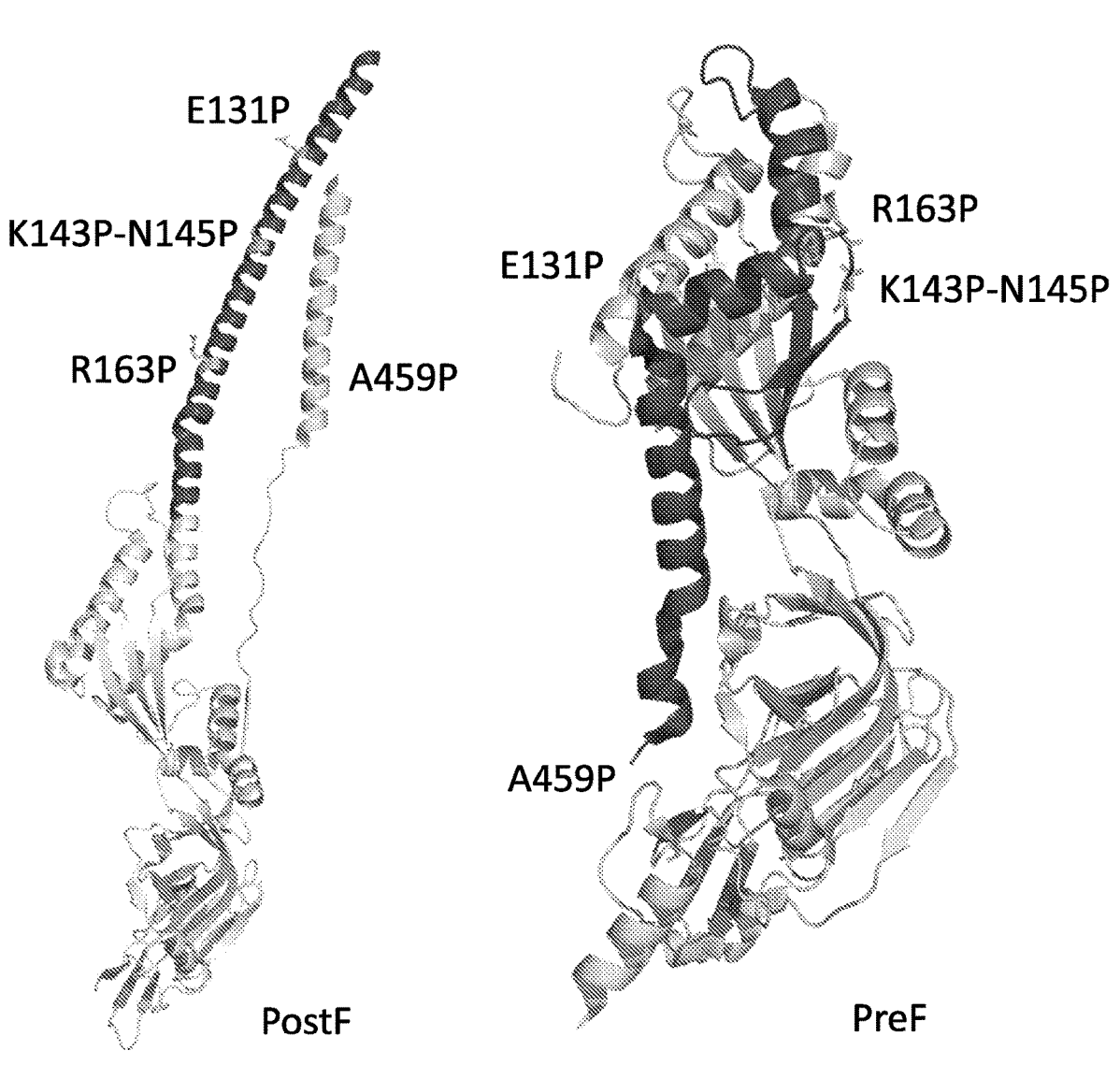
FIG. 18. Design of proline substitutions that stabilize the turn conformation of prefusion HMPV and destabilize the long helical structures of the postfusion conformation.

To provide atomic-level definition, the cryoEM structure for HMPV F v4 from strain B was determined at 3.3 Å resolution from 75,018 particles (FIG. 2B, 11). Residues 19-90 and 180-445 were well-defined in the density. This includes residues 52-63 and 429-445, which are substantially different between post- and prefusion conformations (these residues are colored blue in FIG. 2C). Residues 182 and 188, which formed an IP-DS, with Cys188 introduced by mutation, and Cys182 naturally occurring, and residues 60-63, which formed an intraprotomer disulfide bond are colored in red and magenta, respectively (FIGS. 2D and 9B). Notably residues 91-179 and 446-485, which typically form an extended helical region in the postfusion conformation, were disordered in this molecule. Unmasked density suggests the 182-188 IP-DS interrupted the native helix and redirected the region proceeding, from residues 91-179, outward radially. Overall, the cryoEM defined disulfide pattern for HMPV F v4 comprised an intraprotomer disulfide between 60C-63C and an IP-DS between 182C-188C, with mutations A140C, A147C, K450C, and S470C, which were not defined in the cryoEM reconstruction and likely comprise free cysteines.

Based on the cryoEM-confirmed disulfides (FIG. 9B), the HMPV F v4 with intraprotomer disulfide 60C-A63C and IP-DS 182C-K188C is described hereafter and in FIG. 2. Thus the cryoEM structure of the designed triple disulfide variant revealed it to fold into a postfusion-like conformation, with two unexpected disulfides, one intraprotomeric, and the other interprotomeric in character.

Figure 3A:
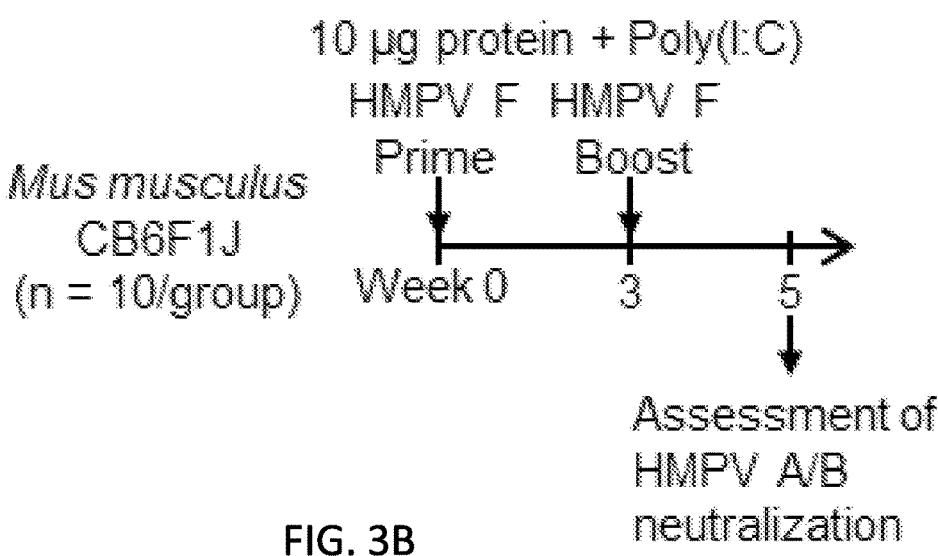
FIGS. 3A-3D. Interprotomer disulfide-stabilized HMPV F variants induce high titer neutralizing responses in mice.

IP-DS-stabilized HMPV F trimers elicit significantly higher neutralizing responses. To evaluate the ability of the IP-DS containing variants of HMPV F to elicit HMPV-neutralizing responses, CB6F1/J mice were immunized with 10 µg doses of each of the designed HMPV F glycoprotein variants (FIG. 3A). The immunogens were combined with 10 µg polyinosinic-polycytidylic acid (poly-I:C) adjuvant at weeks 0 and 3 and measured the ability of week 5 sera in plaque reduction neutralization assays (PRNT). Two viruses were assessed, the subgroup A virus CAN97-83 and the subgroup B virus CAN98-75 (FIG. 3A).

Figure 3B:
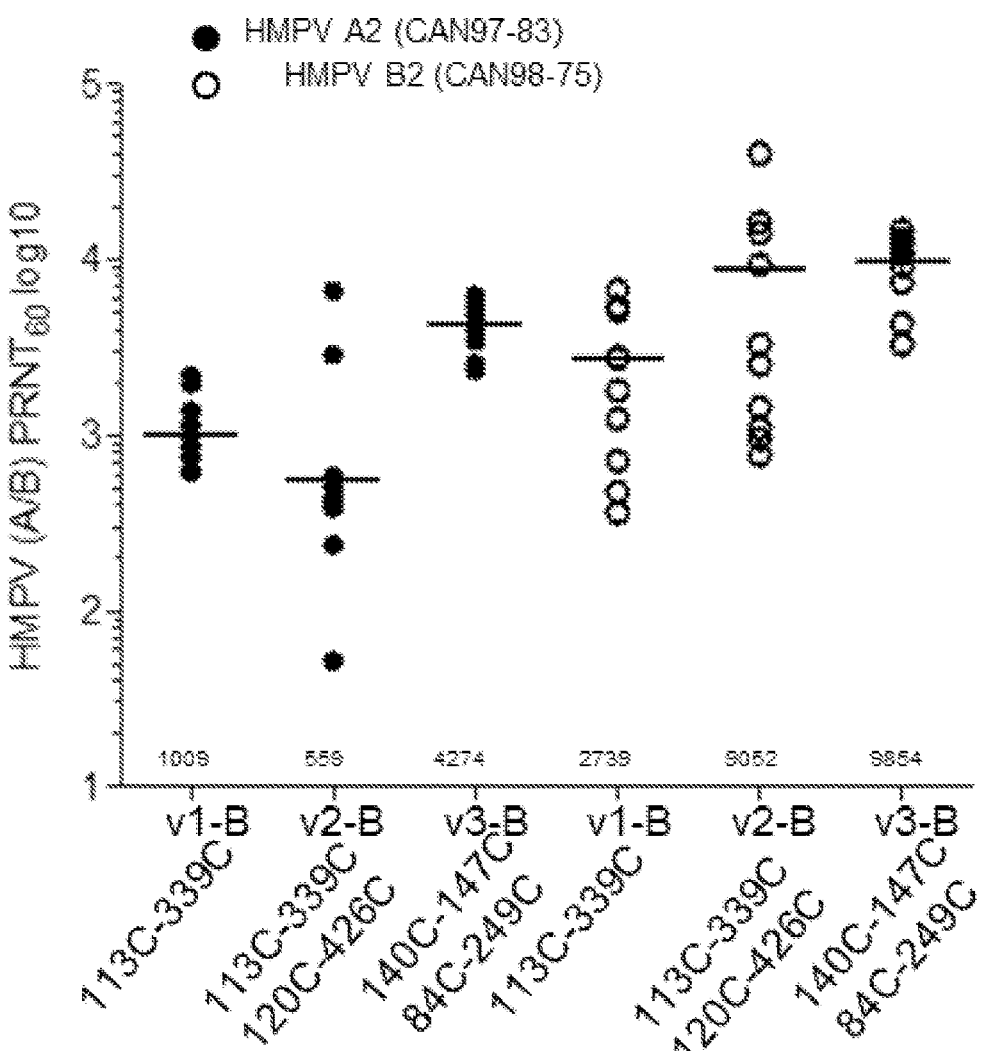

In a first experiment with prefusion immunogens, the three prefusion immunogens described in FIG. 1 were used and neutralization was assessed against both the more distantly related HMPV A2 virus, as well as the more closely related HMPV B2 virus. In all cases, the highest titers were observed with variant v3-B, with both an intraprotomer disulfide (140C-147C) and an IP-DS (84C-249C). Neutralizing titers against the more distantly related A2 virus HMPV, however, were in some cases substantially lower (up to 10-fold) than against the more closely related B strain of HMPV (FIG. 3B), complicating analyses of the impact of disulfides on neutralizing titers.

Figure 3C:
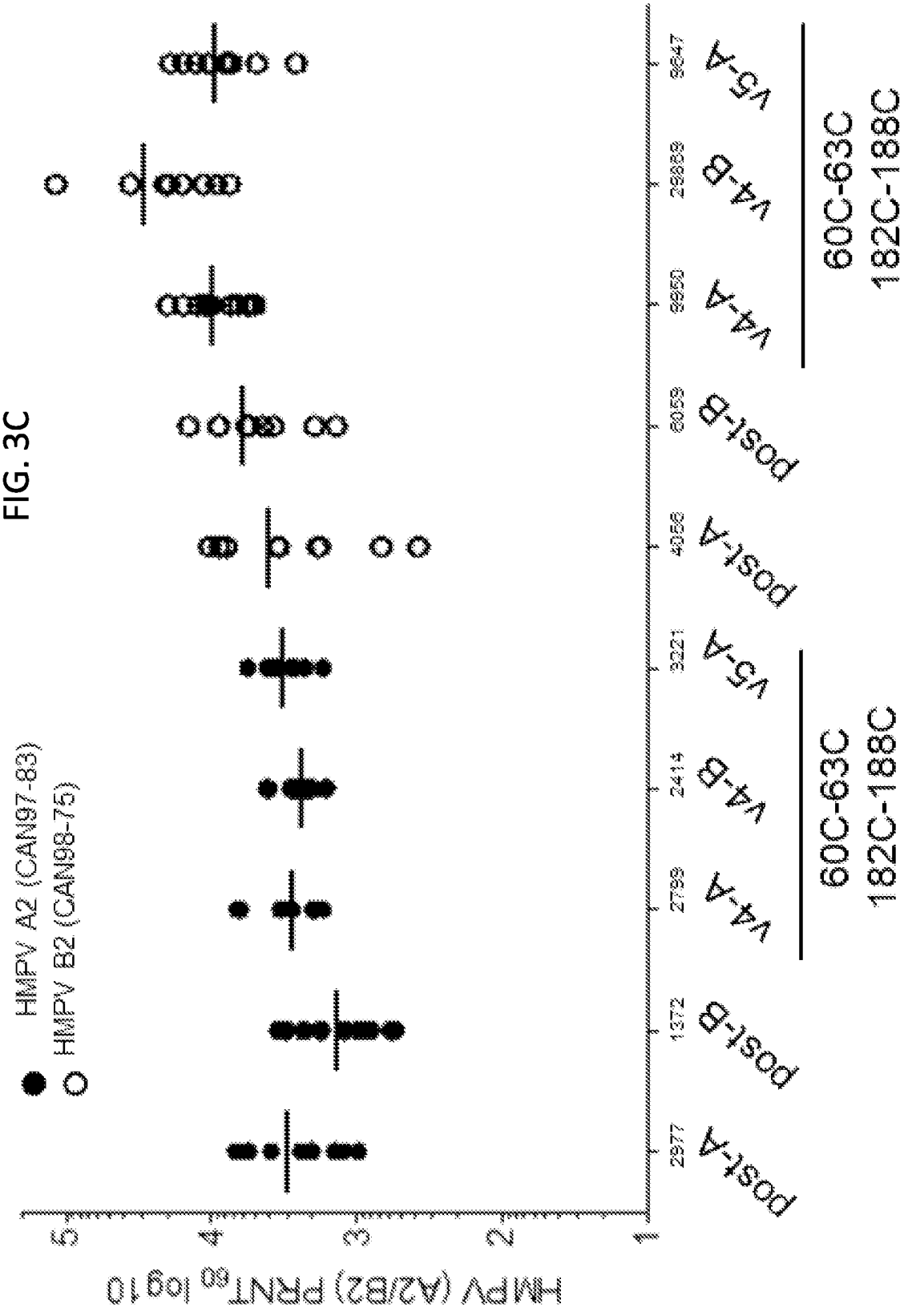

In a second experiment with postfusion immunogens, both HMPV F variants, v4-A and v4-B, were used (FIG. 3C). Also tested was another version of variant v4 in which the engineered mutants for one of the intraprotomer disulfides, K450C to S470C, were reverted (FIG. 3C and FIG. 7A,B). The highest neutralizing responses were observed for HMPV F v4-B—with average geometric mean titers of almost 30,000—as assessed against the homologous B virus CAN98-75. Neutralizing responses, however, were significantly decreased when assessed against the more distantly related A2 virus, with average geometric mean titers of ~3000. By comparison, the neutralization titers elicited by HMPV F v4-A—the A1 version of HMPV F variant v4—showed higher neutralizing titers when assessed against the more distantly related B2 strain, with titers against the more closely related A2 strain about 3-fold lower.

Figure 3D:
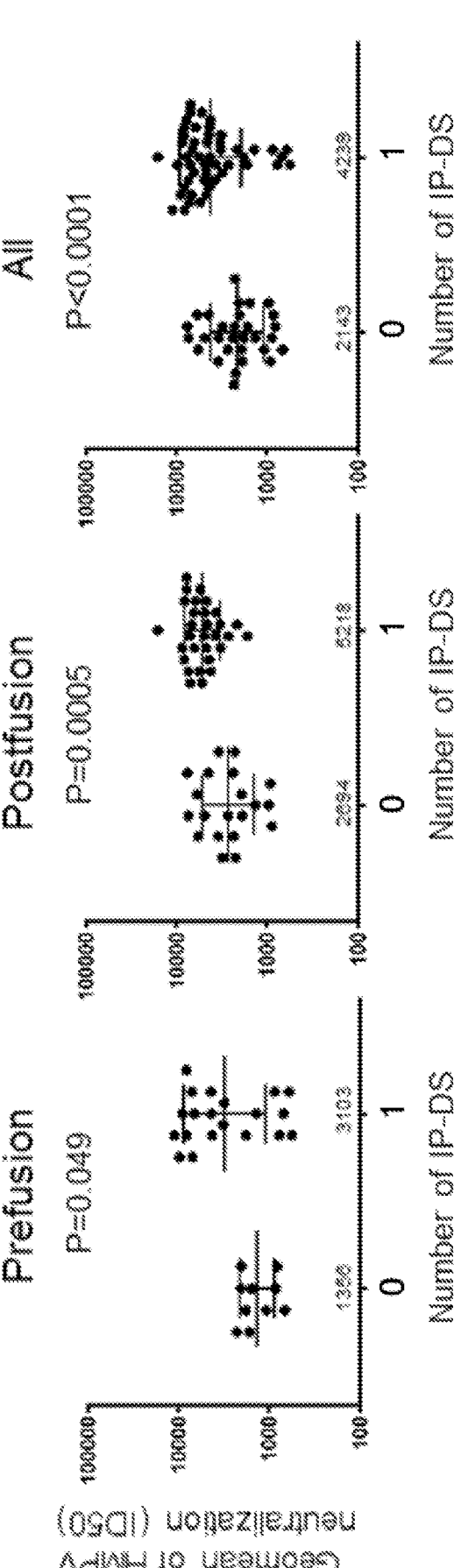

The lack of a consistent ratio of neutralization for strains more closely or more distantly related to the viral sequence of the immunogen may relate to the multiple factors influencing immunogenicity, including differential the immunogenicity of neutralizing epitopes as observed with RSV F subtypes (Joyce et al., Pathog Immun 4, 294-323, 2019). Differences may also relate to differing sensitivity of the viruses themselves, as titers against the B2 viruses were consistently higher than against A2 virus. Despite these confounding factors, when neutralization results from both closely and more distantly related viruses were combined to delineate the impact of IP-DS, in both postfusion (p=0.049) and in prefusion (p=<0.005) forms, IP-DS containing immunogens induced significantly higher HMPV-neutralizing titers (FIG. 3D).

Figure 4A:
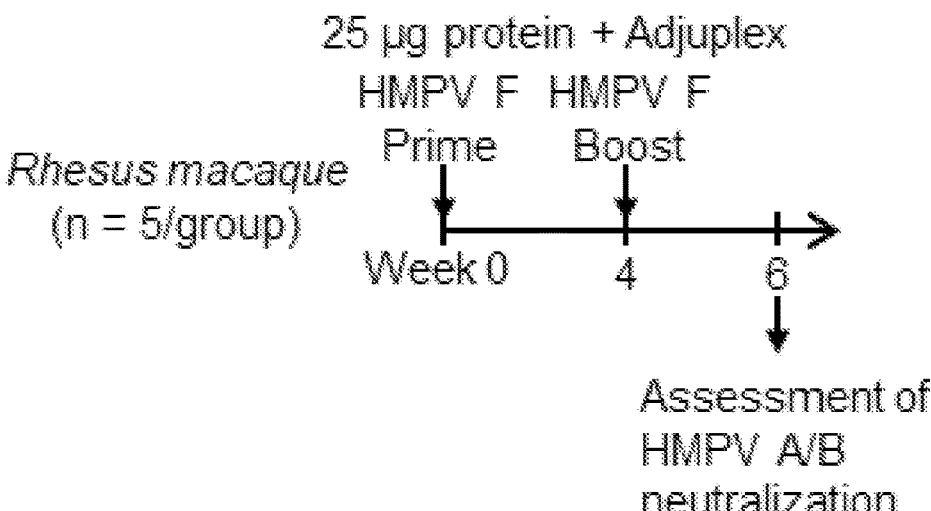
FIGS. 4A-4C. Immunization of rhesus macaques shows interprotomer disulfide-stabilized variants of either prefusion or postfusion HMPV F induce neutralizing responses many times the average titer in healthy adult humans.

IP-DS-stabilized postfusion form of HMPV F induce higher neutralizing titer than non-IP-DS-stabilized HMPV F in macaques. The observation that the IP-DS-stabilized postfusion conformation of HMPV F elicited the highest neutralizing responses was unexpected in light of the prefusion forms of the closely related orthopneumo and respiroviruses inducing higher titers (McLellan et al., Science 342, 592-598, 2013; Joyce et al., Nat Struct Mol Biol 23, 811-820, 2016; Stewart-Jones et al., Proc Natl Acad Sci USA 115, 12265-12270, 2018). As the HMPV F postfusion results were especially significant, it was sought to replicate them with rhesus macaques (NHPs). An immunization regimen comprising immunization with 25 µg F protein at week 0 and 4 and Adjuplex as an adjuvant and assessed serum neutralizing titers at week 6 was used (FIG. 4A). Two groups of 5 NHP were tested. In the first group, the standard postfusion F was used, and in the second group the subtype B HMPV F variant v4-B was used, which contained the IP-DS disulfide 182C-188C, which was confirmed by cryoEM.

Figure 4B:
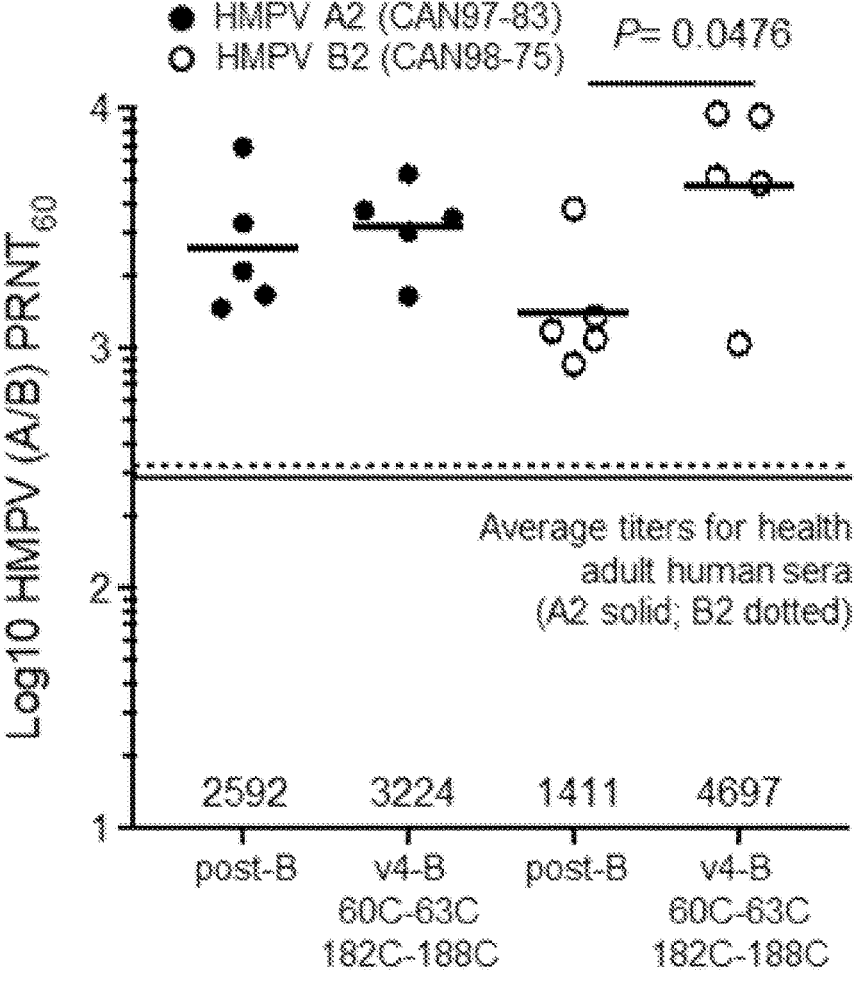
Figure 4C:
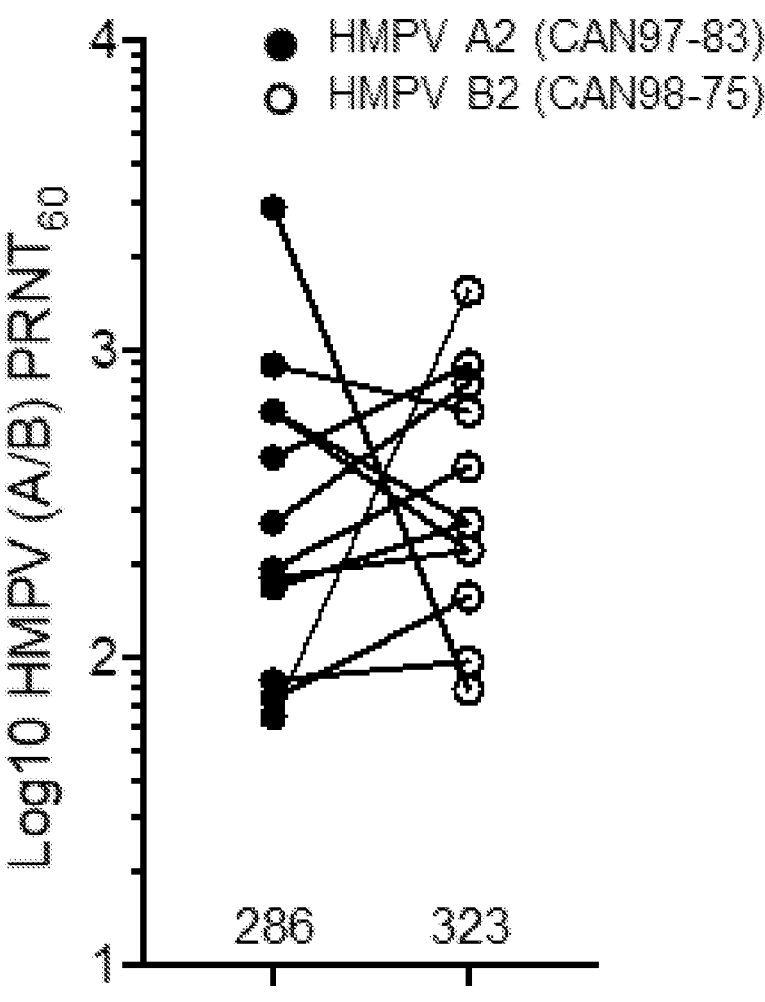

When assessed against the subgroup A2 virus CAN97-83 and the subgroup B2 virus CAN98-75, the IP-DS-containing subgroup B postfusion F induced higher average titers than the non-IP-DS postfusion control, though higher titers were statistically significant only with the B virus, where titers averaged just under 5000 (FIG. 4B). To provide context for these titers, human serum from 12 healthy adults was assessed on the same two viruses. The average titers were 286 against the subgroup A2 virus CAN97-83 and 323 against the subgroup B2 virus CAN98-75 (FIG. 4C). Since most healthy adults do not have recurrent HMPV infection, these titers could be considered above the protective threshold. Notably, the average level of neutralizing responses induced in NHP by immunization with the IP-DS-containing HMPV F variant v4 were 10-fold or more higher than the average level of serum neutralization in this healthy adult cohort.

Figure 5A:
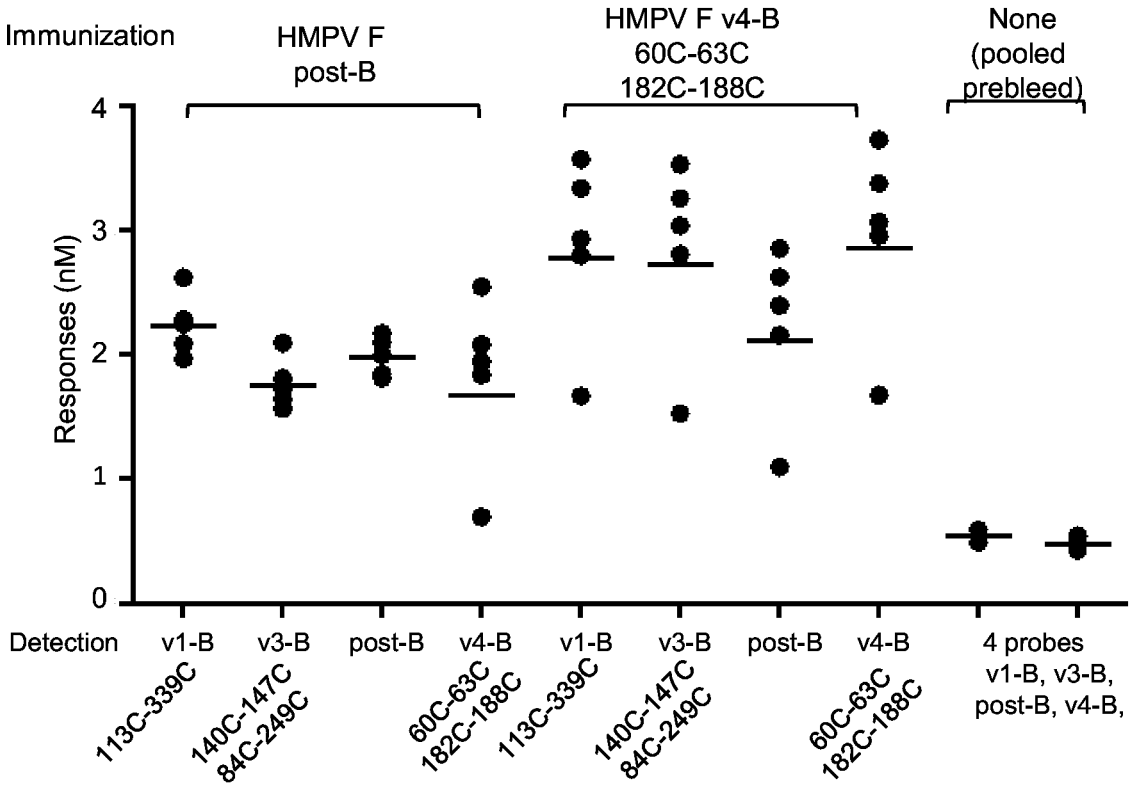
FIGS. 5A-5B. Serum absorption assay indicates neutralizing antibodies target epitopes shared between prefusion and interprotomer disulfide-stabilized postfusion HMPV F (but not non-stabilized postfusion HMPV F).

Serological assessment of serum responses from macaques. To provide insight into the high titer HMPV neutralization induced by HMPV F variant v4 immunization of macaques, both prebleed and week 6 serological responses were assessed (FIG. 5A). Various HMPV F trimers, including variant v1, v3, v4 as well as post-F, were used to probe elicited responses, as quantified by bilayer interferometer (BLI). Low responses (less than 1 nm) were observed with prebleed serum against a cocktail of HMPV F variants. Against the control immunized with HMPV F post-B, probe-detected responses were all in a tight range of ~2 nm; with the IP-DS-stabilized variant v4-B, responses were around 3 nm, except with the post-B control, which were lower. Altogether these results indicate the IP-DS stabilized variant v4-B to elicit high-titer responses that appeared to be more "prefusion F" than "postfusion F" in nature.

Figure 5B:
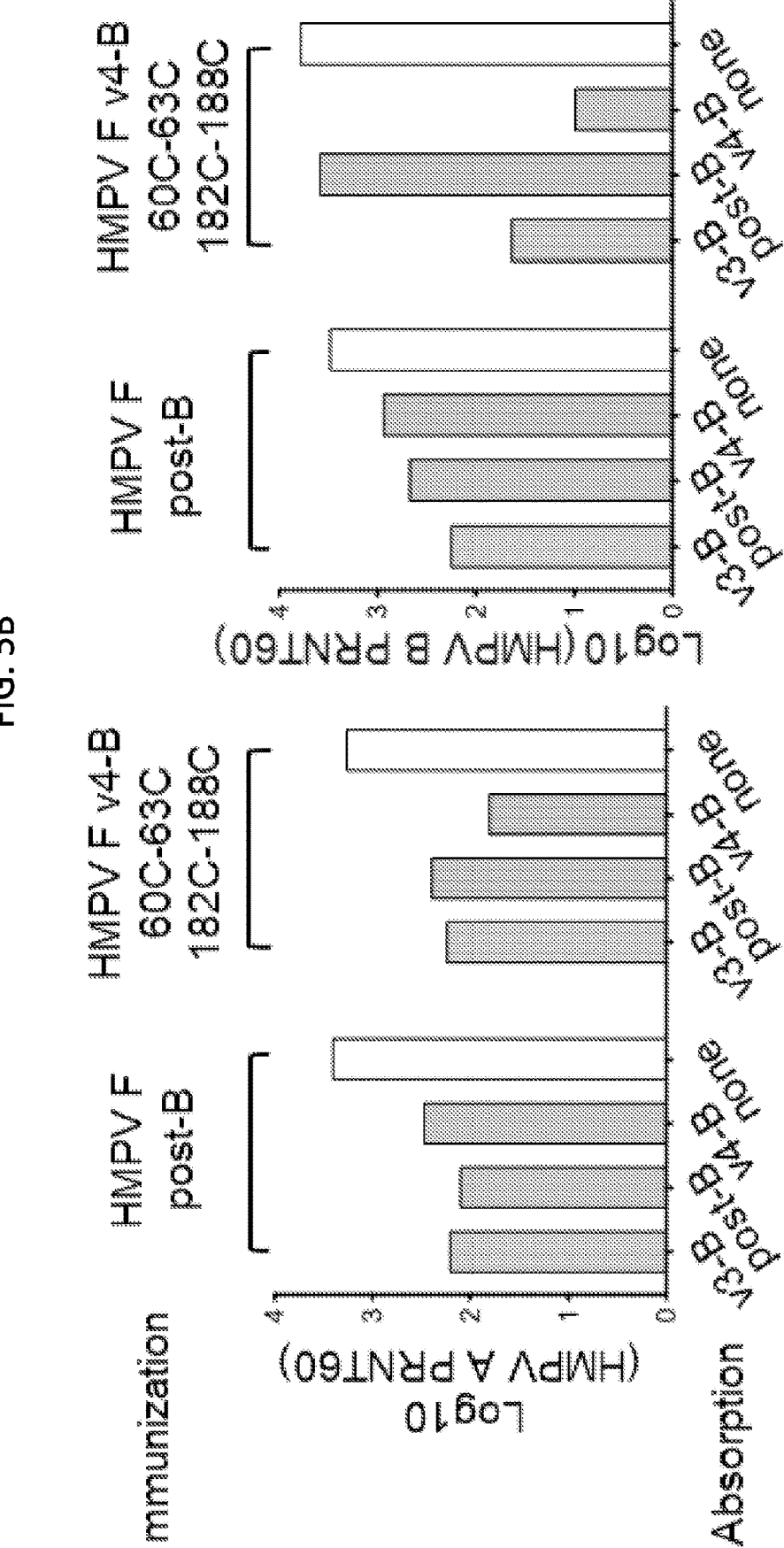

Absorption coupled to neutralization was also used for assessment to determine which of the elicited responses were capable of neutralizing HMPV (FIG. 5B). When assessed against the more divergent A2 virus, both prefusion F (v3) and postfusion F (v4-B or post-B) absorption reduced neutralizing titers similarly, suggesting elicited neutralizing titers against HMPV A virus to be focused on neutralizing epitopes shared between prefusion and postfusion forms of HMPV F (FIG. 5B, left). However, when these immunogens were used to adsorb and serum then tested against the more closely related B virus, the post-B standard absorbed little of the variant v4-B induced neutralization (FIG. 5B, right); this suggested the very high autologous neutralizing titers elicited by HMPV F variant v4-B to be related to neutralizing epitopes shared with prefusion HMPV F (such as displayed by v3-B).

Discussion

Globally, humans have acquired substantial immunity to HMPV, with HMPV disease impacting those that have not been exposed to HMPV (e.g. infants and young children) or with weakened immunity (e.g. the elderly). In this example, it is observed that in healthy adult donors, neutralization titers to HMPV subgroups A and B were moderate with geometric means of around 300 (FIG. 4C); since adults are generally resistant to HMPV infection, this level of neutralizing titer would thus appear to be generally protective.

It was hypothesized that IP-DS-stabilized HMPV F trimers would induce high-titer protective responses. With IP-DS-stabilized HMPV F v3-B stabilized in a prefusion form (FIGS. 1 and 3), strong neutralizing responses were observed, averaging 4000-10,000 in mice, and with IP-DS-stabilized HMPV v4-B stabilized in a postfusion form (FIGS. 2-4), geometric mean neutralizing titers in mice of ~2000-30,000 and in NHP of ~3000-5000 were observed. As this observed level of HMPV F-induced neutralization was many times the average titer observed in our heathy adult cohort, if the high level of immunogenicity in animal models of either HMPV F variant v3 (prefusion-like) or variant v4 (postfusion) were predictive of immunogenicity in humans, it would be expected that immunization with these improved antigens would induce protective responses.

The increase in neutralizing titer related specifically to IP-DS stabilization appeared moderate (FIG. 3D). The relatively modest observed increase in the context of very high overall levels of elicited neutralization likely stems from confounding effects of subtype specificity as well as the substantial increase in titer related to immunization with F in either prefusion or postfusion forms (FIGS. 3 and 4). In general, the ability of postfusion HMPV F to induce high titer neutralizing responses was unexpected in light of repeated failure of postfusion RSV F to induce similarly high responses (McLellan et al., Science 342, 592-598, 2013; Joyce et al., Nat Struct Mol Biol 23, 811-820, 2016; Joyce et al., Pathog Immun 4, 294-323, 2019). One possible explanation may relate to the additional N-linked glycosylation on prefusion HMPV F, proximal to the potent neutralizing epitopes at the F trimer apex, which has been shown to dominate the neutralization of RSV F (Ngwuta et al., Sci Transl Med 7, 309ra162, 2015). Another possibly relates to the higher flexibility observed with HMPV F, as evidenced by "blurring" of negative-stain electron micrographs of non-IP-DS stabilized prefusion Fs (FIG. 7). It seems likely that the increase in neutralizing titer derives from alteration of an intrinsic properties of the HMPV F variants such as flexibility, as it was observed in both mice and macaques. In this context, it is noted that the cryoEM structure indicated regions both of reduced flexibility (e.g. IP-DS-proximal regions) and of increased flexibility (e.g. the disordered "tail"). By and large, it seems likely that the observed level of neutralizing titer derives from complex interaction between F variant and immune system, such as related to the differential immunogenicity observed for different subtypes of RSV F (Joyce et al., Pathog Immun 4, 294-323, 2019).

Current results demonstrate the utility of IP-DS in increasing the elicited neutralizing titer of HMPV F immunogens in both prefusion and postfusion forms. Overall, IP-DS-stabilized versions of trimeric HMPV F appear to be promising vaccine immunogens to elicit high titer neutralizing responses.

Materials and Methods

Phylogenetic analysis. Paramyxovirus F glycoprotein amino acid sequences were downloaded from Genbank. MAFFT was used to perform alignment of protein sequences (Katoh et al., Nucleic Acids Res 30, 3059-3066, 2002), and neighbor joining phylogenetic tree was constructed by ClustalW (Thompson et al., Curr Protoc Bioinformatics Chapter 2, Unit 2 3, 2002). The phylogenetic tree was visualized by Dendroscope (Huson et al., Syst Biol 61, 1061-1067, 2012).

Structure-based design of disulfide bonds stabilized HMPV F glycoprotein trimers. Designs were based on a refit model of the prefusion PIV-5 F glycoprotein crystal structure (PDB ID 4GIP, 4WSG) (Poor et al., J Virol 89, 3438-3441, 2015; Welch et al., Proc Natl Acad Sci USA 109, 16672-16677, 2012) or the HMPV prefusion structure (5WB0) (Battles et al., Nat Commun 8, 1528, 2017). In total, over 100 HMPV F variants were designed, including 86 different disulfide bonds, 14 combinations of disulfides and cavity-filling mutations, and 6 changes in the C-terminal stem. Sequences of several designs (including signal peptide, Foldon domain, and purification tags) are shown in FIG. 7C-D, as follows:

```
v1-B
                                    (SEQ ID NO: 244)
MATMSWKVMIIISLLITPQHGLKESYLEESCSTITEGYLSVLRTGWYTNV

FTLEVGDVENLTCTDGPSLIKTELDLTKSALRELKTVSADQLAREEQIEN

PRKARFVLGAIALGVCTAAAVTAGIAIAKTIRLESEVNAIKGALKTTNEA

VSTLGNGVRVLAFAVRELKEFVSKNLTSALNKNKCDIADLKMAVSFSQFN

RRFLNVVRQFSDNAGITPAISLDLMTDAELARAVSYMPTSAGQIKLMLEN

RAMVRRKGFGILIGVYGSSVIYMVQLPIFGVIDTPCWIIKAAPSCSEKDG

NYACLLREDQGWYCKNAGSTVYYPNDKDCETRGDHVFCDTACGINVAEQS

RECNININISTTNYPCKVSTGRHPISMVALSPLGALVACYKGVSCSIGSNRV

GIIKQLPKGCSYITNQDADTVTIDNTVYQLSKVEGEQHVIKGRPVSSSFD

PIKFPEDQFNVALDQVFESIENSQALVDQSNKILNSAESAIGGYIPEAPR

DGQAYVRKDGEWVLLSTFLGGLVPRGSHHHHHHSAWSHPQFEK v2-B
                                    (SEQ ID NO: 245)
MATMSWKVMIIISLLITPQHGLKESYLEESCSTITEGYLSVLRTGWYTNV

FTLEVGDVENLTCTDGPSLIKTELDLTKSALRELKTVSADQLAREEQIEN

PRKARFVLGAIALGVCTAAAVTCGIAIAKTIRLESEVNAIKGALKTTNEA

VSTLGNGVRVLAFAVRELKEFVSKNLTSALNKNKCDIADLKMAVSFSQFN

RRFLNVVRQFSDNAGITPAISLDLMTDAELARAVSYMPTSAGQIKLMLEN

RAMVRRKGFGILIGVYGSSVIYMVQLPIFGVIDTPCWIIKAAPSCSEKDG

NYACLLREDQGWYCKNAGSTVYYPNDKDCETRGDHVFCDTACGINVAEQS

RECNININISTTNYPCKVSTGRHPISMVALSPLGALVACYKGVSCSIGSNRV

GIIKQLPKGCSYITNQDADTVTIDNTVYCLSKVEGEQHVIKGRPVSSSFD
```

-continued

```
PIKFPEDQFNVALDQVFESIENSQALVDQSNKILNSAESAIGGYIPEAPR

DGQAYVRKDGEWVLLSTFLGGLVPRGSHHHHHHSAWSHPQFEK v3-B
                                     (SEQ ID NO: 246)
MSWKVMIIISLLITPQHGLKESYLEESCSTITEGYLSVLRTGWYTNVFTL

EVGDVENLTCTDGPSLIKTELDLTKSALRELKTCSADQLAREEQIEGGGG

GGFVLGAIALGVATAAAVTAGIAIAKTIRLESEVNAIKGCLKTTNECVST

LGNGVRVLATAVRELKEFVSKNLTSAINKNKCDIPDLKMAVSFSQFNRRF

LNVVRQFSDNAGITPAISLDLMTDAELARAVSYMPTSAGQIKLMLENRCM

VRRKGFGILIGVYGSSVIYMVQLPIFGVIDTPCWIIKAAPSCSEKDGNYA

CLLREDQGWYCKNAGSTVYYPNDKDCETRGDHVFCDTAAGINVAEQSREC

NINISTTNYPCKVSTGRHPISMVALSPLGALVACYKGVSCSIGSNRVGII

KQLPKGCSYITNQDADTVTIDNTVYQLSKVEGEQHVIKGRPVSSSFDPIK

FPEDQFNVALDQVFESIENSQALVDQSNKILNSAESAIGGYIPEAPRDGQ

AYVRKDGEWVLLSTFLGGLVPRGSHHHHHHSAWSHPQFEK v4-A
                                     (SEQ ID NO: 247)
MSWKVVIIFSLLITPQHGLKESYLEESCSTITEGYLSVLRTGWYTNVFTL

EVGDVENLTCSDCPSLIKTELDLTKSALRELKTVSADQLAREEQIEGGGG

GGFVLAIALGVATAAAVTAGVAIAKTIRLESEVTAIKNCLKTTNECVSTL

GNGVRVLATAVRELKDFVSKNLTRAINKNKCDIDDLCMAVSFSQFNRRFL

NVVRQFSDNAGITPAISLDLMTDAELARAVSNMPTSAGQIKLMLENRAMV

RRKGFGILIGVYGSSVIYMVQLPIFGVIDTPCWIVKAAPSCSGKKGNYAC

LLREDQGWYCQNAGSTVYYPNEKDCETRGDHVFCDTAAGINVAEQSKECN

INISTTNYPCKVSTGRHPISMVALSPLGALVACYKGVSCSIGSNRVGIIK

QLNKGCSYITNQDADTVTIDNTVYQLSKVEGEQHVIKGRPVSSSFDPICF

PEDQFNVALDQVFENIENCQALVDQSNRILSSAESAIGGYIPEAPRDGQA

YVRKDGEWVLLSTFLGGLVPRGSHHHHHHSAWSHPQFEK v4-B
                                     (SEQ ID NO: 248)
MSWKVMIIISLLITPQHGLKESYLEESCSTITEGYLSVLRTGWYTNVFTL

EVGDVENLTCTDCPSLIKTELDLTKSALRELKTVSADQLAREEQIEGGGG

GGFVLGAIALGVATAAAVTAGIAIAKTIRLESEVNAIKGCLKTTNECVST

LGNGVRVLATAVRELKEFVSKNLTSAINKNKCDIADLCMAVSFSQFNRRF

LNVVRQFSDNAGITPAISLDLMTDAELARAVSYMPTSAGQIKLMLENRAM

VRRKGFGILIGVYGSSVIYMVQLPIFGVIDTPCWIIKAAPSCSEKDGNYA

CLLREDQGWYCKNAGSTVYYPNDKDCETRGDHVFCDTAAGINVAEQSREC

NINISTTNYPCKVSTGRHPISMVALSPLGALVACYKGVSCSIGSNRVGII

KQLPKGCSYITNQDADTVTIDNTVYQLSKVEGEQHVIKGRPVSSSFDPIC

FPEDQFNVALDQVFESIENCQALVDQSNKILNSAESAIGGYIPEAPRDGQ

AYVRKDGEWVLLSTFLGGLVPRGSHHHHHHSAWSHPQFEK
```

-continued

```
v5-A
                                     (SEQ ID NO: 249)
MSWKVVIIFSLLITPQHGLKESYLEESCSTITEGYLSVLRTGWYTNVFTL

EVGDVENLTCSDCPSLIKTELDLTKSALRELKTVSADQLAREEQIEGGGG

GGFVLAIALGVATAAAVTAGVAIAKTIRLESEVTAIKNCLKTTNECVSTL

GNGVRVLATAVRELKDFVSKNLTRAINKNKCDIDDLCMAVSFSQFNRRFL

NVVRQFSDNAGITPAISLDLMTDAELARAVSNMPTSAGQIKLMLENRAMV

RRKGFGILIGVYGSSVIYMVQLPIFGVIDTPCWIVKAAPSCSGKKGNYAC

LLREDQGWYCQNAGSTVYYPNEKDCETRGDHVFCDTAAGINVAEQSKECN

INISTTNYPCKVSTGRHPISMVALSPLGALVACYKGVSCSIGSNRVGIIK

QLNKGCSYITNQDADTVTIDNTVYQLSKVEGEQHVIKGRPVSSSFDPIKF

PEDQFNVALDQVFENIENSQALVDQSNRILSSAESAIGGYIPEAPRDGQA

YVRKDGEWVLLSTFLGGLVPRGSHHHHHHSAWSHPQFEK post-A
                                     (SEQ ID NO: 250)
MSWKVVIIFSLLITPQHGLKESYLEESCSTITEGYLSVLRTGWYTNVFTL

EVGDVENLTCSDGPSLIKTELDLTKSALRELKTVSADQLAREEQIENRRR

RRAIALGVATAAAVTAGVAIAKTIRLESEVTAIKNALKTTNEAVSTLGNG

VRVLATAVRELKDFVSKNLTRAINKNKCDIDDLKMAVSFSQFNRRFLNVV

RQFSDNAGITPAISLDLMTDAELARAVSNMPTSAGQIKLMLENRAMVRRK

GFGILIGVYGSSVIYMVQLPIFGVIDTPCWIVKAAPSCSGKKGNYACLLR

EDQGWYCQNAGSTVYYPNEKDCETRGDHVFCDTAAGINVAEQSKECNINI

STTNYPCKVSTGRHPISMVALSPLGALVACYKGVSCSIGSNRVGIIKQLN

KGCSYITNQDADTVTIDNTVYQLSKVEGEQHVIKGRPVSSSFDPIKFPED

QFNVALDQVFENIENSQALVDQSNRILSSAESAIGGLVPRGSHHHHHHSA

WSHPQFEK post-B
                                     (SEQ ID NO: 251)
MSWKVMIIISLLITPQHGLKESYLEESCSTITEGYLSVLRTGWYTNVFTL

EVGDVENLTCTDGPSLIKTELDLTKSALRELKTVSADQLAREEQIENRRR

RRAIALGVATAAAVTAGIAIAKTIRLESEVNAIKGALKTTNEAVSTLGNG

VRVLATAVRELKEFVSKNLTSAINKNKCDIADLKMAVSFSQFNRRFLNVV

RQFSDNAGITPAISLDLMTDAELARAVSYMPTSAGQIKLMLENRAMVRRK

GFGILIGVYGSSVIYMVQLPIFGVIDTPCWIIKAAPSCSEKDGNYACLLR

EDQGWYCKNAGSTVYYPNDKDCETRGDHVFCDTAAGINVAEQSRECNINI

STTNYPCKVSTGRHPISMVALSPLGALVACYKGVSCSIGSNRVGIIKQLP

KGCSYITNQDADTVTIDNTVYQLSKVEGEQHVIKGRPVSSSFDPIKFPED

QFNVALDQVFESIENSQALVDQSNKILNSAESAIGGLVPRGSHHHHHHSA

WSHPQFEK
```

Antigenic screening of HMPV F immunogens. Initial assessment of all constructs were performed using a 96-well microplate format for high throughput expression followed by an ELISA-based antigenic evaluation as described previously (McLellan et al., Science 342, 592-598, 2013). Briefly, 24 h prior to transfection HEK 293T cells (Thermo Fisher Scientific, MA) were seeded in each well of a 96-well microplate at a density of $2.5 \times 10^5$ cells/ml in expression medium (high glucose DMEM supplemented with 10% ultra-low IgG fetal bovine serum and 1×-non-essential amino acids), and incubated at 37° C., 5% $CO_2$ for 20 h. Plasmid DNA and TrueFect-Max (United BioSystems, MD) were mixed and added to the growing cells, and the 96-well plate incubated at 37° C., 5% $CO_2$. One day post transfection, enriched medium (high glucose DMEM plus 25% ultra-low IgG fetal bovine serum, 2× nonessential amino acids, 1× glutamine) was added to each well, and the 96-well plate was returned to the incubator for continuous culture. Five days post transfection, supernatants with the expressed HMPV F variants were harvested and tested by ELISA for binding to MPE8, MPE33, MPF5 and ADI15614 antibodies using $Ni^{2+}$-NTA microplates.

Protein expression and purification. HMPV F glycoproteins were expressed by transfection in 293F cells (Thermo Fisher) with Turbo293 transfection reagent (SPEED Bio-System) using established protocol. The culture supernatant was harvested 6 days post transfection, and proteins were purified from the supernatants by nickel-(Roche) and Strep-Tactin-affinity (IBA lifesciences). Purification tags were removed by thrombin digestion overnight at room temperature, and the proteins were further purified by size-exclusion chromatography in a Superdex 200 column (GE) in PBS.

HMPV F antigenic characterization. A fortéBio Octet Red384 instrument was used to measure binding kinetics of HMPV F variants to antibodies that target the prefusion or postfusion F form (MPE8, MPE33 and MPF5). Assays were performed at 30° C. in tilted black 384-well plates (Geiger Bio-One). Ni-NTA sensor tips were used to capture relevant HMPV F variants. The phosphate-buffered saline (PBS) supplemented with 1% bovine serum albumin (BSA) were used to minimize nonspecific interactions. Ni-NTA sensor tips (fortdBio) were used to load histidine-tagged proteins for 300 s to allow capture. Biosensor tips were then equilibrated for 60 s in PBS with 1% BSA before measurement of association with antigen-binding fragments (Fabs) in solution (0.007 μM to 0.5 μM) for 300 s; Fabs were then allowed to dissociate for 300-1,200 s depending on the observed dissociation rate. Parallel correction to subtract systematic baseline drift was carried out by subtraction of the measurements recorded for a loaded sensor incubated in PBS and 1% BSA. Data analysis and curve fitting were carried out using Octet software, version 9.0. Experimental data were fitted with the binding equations describing a 1:1 interaction. Global analysis of the data sets assuming reversible binding (full dissociation) were carried out using nonlinear least-squares fitting allowing a single set of binding parameters to be obtained simultaneously for all of the concentrations used in each experiment.

Negative-stain electron microscopy. Protein samples were diluted to approximately 0.02 mg/ml with 10 mM HEPES, pH 7.0, 150 mM NaCl, adsorbed to a freshly glow-discharged carbon-coated copper grid, washed with the same buffer, and negatively stained with 0.75% uranyl formate. Datasets were collected at a magnification of 100,000 (pixel size: 0.22 nm) using SerialEM (Mastronarde et al., J Struct Biol 152, 36-51, 2005) on an FEI Tecnai T20 electron microscope equipped with a 2 k×2 k Eagle CCD camera and operated at 200 kV, as well as at a magnification of 57,000 (pixel size: 0.25 nm) using EPU on a ThermoFisher Talos F200C electron microscope equipped with ThermoFisher Ceta CCD camera and operated at 200 kV. Particles were picked using e2boxer from the EMAN2 software package (Tang et al., J Struct Biol 157, 38-46, 2007) as well as using in-house developed automatic software (unpublished). Reference-free 2D classifications were performed using Relion (Scheres, J Struct Biol 180, 519-530, 2012).

Cryo-EM data collection and processing. HMPV-v4-B alone was concentrated to 3.1 mg/ml in PBS and 2.3 μl was deposited on a C-flat grid (protochip.com). HMPV-v3-B was incubated with 2 fold molar excess MPE33 Fab and concentrated to 1 mg/ml in PBS. An FEI Vitrobot Mark IV was used for vitrification in ethane with a wait time of 30 seconds, blot time of 3 seconds and blot force of 0. Data collection was performed with Leginon (Suloway et al., J Struct Biol 151, 41-60, 2005) with a Gatan K2 Summit direct detection device on a Titan Krios electron microscope. Exposures were collected in movie mode for a 10 s with divided into 50 raw frames. Images were pre-processed using Appion (Voss et al., J Struct Biol 166, 205-213, 2009; Lander et al., J Struct Biol 166, 95-102, 2009); individual frames were aligned and dose-weighted using MotionCor2 (Zheng et al., 2017). CTFFind4 (Rohou et al., J Struct Biol 192, 216-221, 2015; Zhang, J Struct Biol 193, 1-12, 2016) was used to estimate the contrast transfer function and DoG Picker (Voss et al., J Struct Biol 166, 205-213, 2009; Lander et al., J Struct Biol 166, 95-102, 2009) was used for particle picking. RELION was then used for extracting particles. CryoSPARC 2.12 (Punjani et al., Nat Methods 14, 290-296, 2017) was implemented for 2D classifications, ab initio 3D reconstruction, homogeneous refinement, and nonuniform 3D refinement. Initial 3D reconstructions were performed using C1 symmetry, C3 symmetry was applied for the final reconstructions and refinements.

Coordinates from PDB ID 5WB0 and 5L1X were used for initial fits to the reconstructed maps. Coordinates were processed using simulated annealing and real space refinement in Phenix (Adams et al., J Synchrotron Radiat 11, 53-55, 2004) and then iteratively adjusted with manual fitting of the coordinates in Coot (Emsley et al., Acta Crystallogr D Biol Crystallogr 60, 2126-2132, 2004). Validation criteria were evaluated throughout the process using Molprobity (Davis et al., Nucleic Acids Res 32, W615-619, 2004) and EMRinger (Barad et al., Nat Methods 12, 943-946, 2015). PyMOL (pymol.org) was used to generate figures.

Immunogenic characterization of HMPV F glycoprotein trimer designs in mice. To assess the effectiveness of recombinant HMPV F trimer designs at eliciting neutralizing antibodies, groups of 10 CB6F1/J mice were immunized twice at weeks 0 and 3 intramuscularly with 10 μg of recombinant HMPV F glycoprotein trimer designs combined with 10 μg Poly I:C and week 5 sera were assessed for autologous and heterologous HMPV virus neutralization in vitro. Neutralizing antibody titers were determined using HMPV plaque-reduction neutralization assays on Vero cells (Karron et al., J Pediatric Infect Dis Soc 7, 86-89, 2018).

Immunogenic characterization of HMPV F glycoprotein trimer designs in non-human primates. All animal experiments were reviewed and approved by the Animal Care and Use Committee of the Vaccine Research Center, NIAID, NIH and all animals were housed and cared for in accordance with local, state, federal and institute policies in an American Association for Accreditation of Laboratory Animal Care (AAALAC)-accredited facility at the NIH. Female and male Indian rhesus macaques with body weights between 2-9 kg were used for immunization studies. For each immunization, 1 ml of 25 μg immunogen mixed with 20% of Adjuplex (Wegmann et al., Clin Vaccine Immunol 22, 1004-1012, 2015) (Empirion LLC, Columbus, OH) in PBS, was injected via a needle syringe into the caudal thighs of the two hind legs. Blood was collected two weeks post immunization for serological analyses.

Sera antigenic analysis. Rhesus macaques sera from the immunization groups were assessed for binding to HMPV F variants. NTA sensor tips obtained from fortéBio were equilibrated in PBS before the assays. HMPV trimeric variants at 20 μg/ml in 1% BSA/PBS was loaded onto NTA biosensors for 300 s. The sensor tips were subsequently equilibrated in 1% BSA/PBS for 60 s, and this was followed by a week 6 1:100 serum association step for 300 s and a subsequent dissociation step for an additional 60 s. As a reference, a parallel assay was performed using the pooled prebleed sera to determine the serum response prior immunization.

Serum adsorption assay. Serum sample (40 μl) from each animal was pooled within each group and diluted in 1.8 ml PBS buffer. 2 ml diluted serum was split into four parts. 10 microgram of HMPV F variants (20 ul) was added to 500 μl of diluted samples and incubated for 2 hours at room temperature. For the positive control, 20 ul of PBS without protein was added to 500 μl of diluted serum. All samples were then incubated at RT for 2 hours, followed by addition of 0.2 ml NTA beads to each sample. The mixture was placed on a 360° rotator at room temperature and incubated two hours. The mixture was then loaded on 5 mL single-used column and washed twice with 1 ml PBS buffer. The flow-through was collected and concentrated to 100 uL for neutralization assay (Ngwuta et al., Sci Transl Med 7, 309ra162, 2015).

Example 2

Optimization of HMPV F Prefusion Proteins

This example illustrates further optimization of the v3B HMPV F immunogen described in Example 1.

The v3B immunogen is a recombinant HMPV F trimer stabilized in the prefusion conformation V84C/A249C substitutions forming a non-native disulfide bond, A140C/A147C substitutions forming a non-native disulfide bond, and substitution of HMPV positions 97-102 to GGGGGG (SEQ ID NO: 147) to remove the F1/F2 cleavage site. An amino acid sequence for v3B is provided herein as SEQ ID NO: 246.

A multi-pronged approach was taken to further optimize v3B.

First, the mutation to remove the F1/F2 cleavage site was altered to optimize expression and antigenicity. Nine different variants were assessed (see FIG. 12) and the HMPV_v3B_L0.1 variant which includes the V84C/A249C substitutions, A140C/A147C substitutions, and substitution of HMPV F positions 89-112 to GSGGSG (SEQ ID NO: 146) was found to improve yield by greater than 10-fold compared to v3B, to increase binding to the prefusion specific antibody MPE8 by greater than 10 fold compared to v1B, and to provide for negative stain EM showing a visible short C-terminal tail that is more clear than that observed for v3B (see FIG. 13). HMPV F proteins described herein as having a Δ12 mutation contain the substitution of HMPV F positions 89-112 to GSGGSG (SEQ ID NO: 146).

Second, additional interprotomer disulfide bonds were introduced into v3B and v3BΔ12 to increase stability of the prefusion structure. Several mutations were designed (see FIG. 14) and two assessed and shown to be effective: T365C/Q455C substitutions forming a non-native interprotomer disulfide bond, and D454C/V458C substitutions forming a non-native interprotomer disulfide bond. FIGS.

15A and 15B show that v3BΔ12 with either of these substitutions can be expressed, purified, and identified in the prefusion conformation by negative stain EM. Antigenic assessment for binding to MPE8 shows that the addition of the Δ12 mutation to v3B increases binding affinity for MPE8, and that addition of the D454C/V458C substitutions further increased MPE8 binding affinity (FIG. 16). The constructs showed similar or improved binding affinity for MPF5 and MPE33 antibodies compared to v3BΔ12 (FIG. 17).

Figure 20:
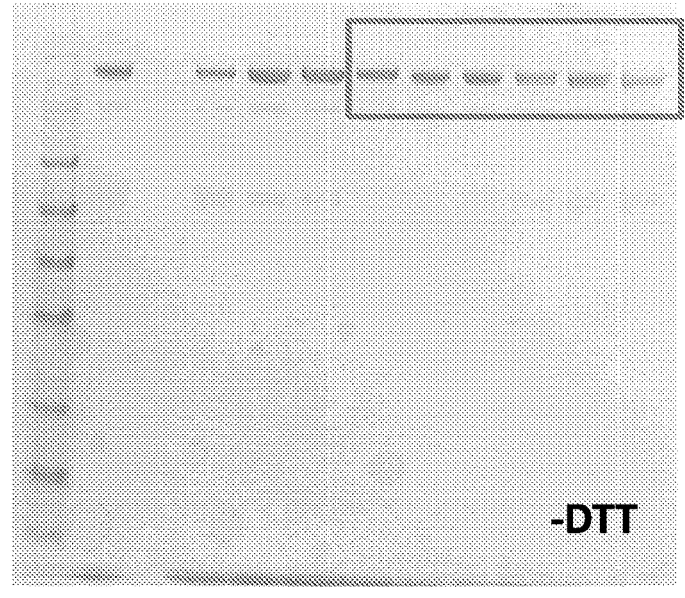

Third, proline mutations were introduced that stabilize the prefusion turn conformation and destabilize the long helical structures of the postfusion conformation. Several mutations were designed and assessed, including E131P, K143P, N145P, R163P, A459P, and combinations thereof. HMPV F v3BΔ12 variants with the individual proline mutations were expressed, purified as a single trimer peak on SEC, identified in the prefusion conformation by negative stain EM and MPE8 binding, and shown to contain interprotomer disulfide bonds by PAGE analysis (see FIGS. 19 and 20). The single R163P mutant and double E131P-R163P mutant showed dramatically improved yield. Analysis of additional combinations of the proline mutations identified a triple mutant E131P, R163P, and A459P that when introduced into HMPV F v3BΔ12 increased expression by approximately 100× compared to the v3B construct (FIG. 21). Antigenic assessment for binding to MPE8 shows that the addition of the proline substitutions to HMPV F v3BΔ12 increased binding affinity for MPE8 (FIG. 22). The HMPV F variants showed similar binding affinity for MPF5 and MPE33 antibodies (FIG. 23).

Combinations of the above modifications were introduced into HMPV F v3B and assessed for binding to MPE8, with all but two demonstrating improved binding to MPE8 relative to HMPV F v3BΔ12 (FIG. 24).

Example 3

In Vivo Assessment of Recombinant HMPV F Immunogens

This example illustrates elicitation of a neutralizing immune response by HMPV F ectodomain trimers as described herein.

To assess the effectiveness of recombinant HMPV F ectodomain trimer designs at eliciting neutralizing antibodies, groups of 10 CB6F1/J mice were immunized twice at weeks 0 and 3 intramuscularly with 10 μg of recombinant HMPV F glycoprotein trimer designs combined with 10 μg Poly I:C and week 5 sera were assessed for autologous and heterologous HMPV virus neutralization in vitro. Neutralizing antibody titers were determined using HMPV plaque-reduction neutralization assays substantially as described in Example 1, but with a different HMPV viral stock.

In a first neutralization assay (FIG. 25A), sera from mice immunized with HMPV F WT-Fd, HMPV F v3BΔ12 DS365, HMPV F v3BΔ12 DS365 3P, HMPV F PostF, HMPV F v4B, and HMPV F v4B-Δ10 was assessed. In a second assay (FIG. 25B), sera from mice immunized with HMPV F DS-Cav1, HMPV F v3BΔ12, HMPV F v3BΔ12 3P, HMPV F v3BΔ12 DS454, HMPV F v3BΔ12 3P-DS454 was assessed. All the immunogens were based on the subtype B2, CAN98-75 HMPV strain. All the immunogens were purified soluble HMPV F ectodomain trimer with a C-terminal T4 Fibritin trimerization domain and containing the indicated mutations for prefusion or postfusion stabilization.

"DS-Cav1" refers to A113C/A339C, T160F, and I177L substitutions, "v3BΔ12" refers to A140C/A147C, V84C/A249C, and 89-112GSGGSG (SEQ ID NO: 146) substitutions, "DS454" refers to D454C/V458C substitutions, "DS365" refers to T365C/Q455C substitutions, "3P" refers to E131P, R163P, and A459P substitutions, "PostF" refers to 98-106RRRRR (SEQ ID NO: 99) substitution, "V4B" refers to G63C, K188C, A140C/A147C, and 97-102GGGGGG (SEQ ID NO: 147) substitutions, "V4B-Δ10" refers to G63C, K188C, A140C/A147C, 97-102GGGGGG (SEQ ID NO: 147) substitutions, and Δ163-180 deletion. GGGGGG is SEQ ID NO: 147, GSGGSG is SEQ ID NO: 146.

Serum neutralization activity was assessed against autologous strain CAN98-75 and heterologous strain CAN97-83 (FIGS. 25A and 25B). The results show that further stabilization of the HMPV F trimer prefusion conformation with an additional disulfide bond (in addition to the mutations present in v3B) increased the neutralization titer of immunized mice. Further, the Δ12 mutation increased trimer immunogenicity commensurate with the improvement in antigenicity discussed above. The highest titers of neutralizing antibody, against both subtype A and subtype B HMPV, were observed with HMPV F v3BΔ12 DS365 and HMPV F v3BΔ12 DS454.

It will be apparent that the precise details of the methods or compositions described may be varied or modified without departing from the spirit of the described embodiments. We claim all such modifications and variations that fall within the scope and spirit of the claims below.

---

SEQUENCE LISTING (251 sequences)

SEQ ID NO: 1 - protein, 539 aa, human metapneumovirus
MSWKVVIIFSLLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 2 - protein, 539 aa, human metapneumovirus
MSWKVVIIFSLLITPQHGLKESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 3 - protein, 539 aa, human metapneumovirus
MSWKVVIIFSLLITPQHGLKESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 4 - protein, 539 aa, human metapneumovirus
MSWKVVIIFSLLITPQHSLKESYLEESCSTITEGYLSVLRTGWYTNVFTLEVGDVENLTCADGPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 5 - protein, 539 aa, human metapneumovirus
MSWKVMIIISLLITPQHGLKESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 6 - protein, 539 aa, human metapneumovirus; identical to SEQ ID NO: 1

SEQ ID NO: 7 - protein, 539 aa, human metapneumovirus
MSWKVMIIISLLITPQHGLKESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 8 - protein, 493 aa, Artificial Sequence
  Recombinant HMPV F protein
KESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEGGYIPEAPRDGQAYVRKDGEWVLLSTF

SEQ ID NO: 9 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 10 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 11 - protein, 493 aa, Artificial Sequence
  Recombinant HMPV F protein
KESYLEESCSTITEGYLSVLRTGWYTNVFTLEVGDVENLTCADGPSLIKTELDLTKSALRELKPVSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEGGYIPEAPRDGQAYVRKDGEWVLLSTF

SEQ ID NO: 12 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGCLKQTNECVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 13 - protein, 493 aa, Artificial Sequence; identical to SEQ ID NO: 8
  Recombinant HMPV F protein

SEQ ID NO: 14 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGCLKTTNECVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 15 - protein, 493 aa, Artificial Sequence
  Recombinant HMPV F protein
KESYLEESCSTITEGYLSVLRTGWYTNVFTLEVGDVENLTCADGPSLIKTELDLTKSALRELRTCSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEGGYIPEAPRDGQAYVRKDGEWVLLSTF

SEQ ID NO: 16 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 17 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 18 - protein, 493 aa, Artificial Sequence
  Recombinant HMPV F protein
KESYLEESCSTITEGYLSVLRTGWYTNVFTLEVGDVENLTCADGPSLIKTELDLTKSALRELKPCSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEGGYIPEAPRDGQAYVRKDGEWVLLSTF

SEQ ID NO: 19 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 20 - protein, 493 aa, Artificial Sequence; identical to SEQ ID NO: 15
  Recombinant HMPV F protein

SEQ ID NO: 21 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 22 - protein, 493 aa, Artificial Sequence
  Recombinant HMPV F protein
KESYLEESCSTITEGYLSVLRTGWYTNVFTLEVGDVENLTCADGPSLIKTELDLTKSALRELRTCSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEGGYIPEAPRDGQAYVRKDGEWVLLSTF

SEQ ID NO: 23 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 24 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 25 - protein, 493 aa, Artificial Sequence
  Recombinant HMPV F protein
KESYLEESCSTITEGYLSVLRTGWYTNVFTLEVGDVENLTCADGPSLIKTELDLTKSALRELKPCSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEGGYIPEAPRDGQAYVRKDGEWVLLSTF

SEQ ID NO: 26 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGCLKQTNECVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 27 - protein, 493 aa, Artificial Sequence; identical to SEQ ID NO: 22
  Recombinant HMPV F protein

SEQ ID NO: 28 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGCLKTTNECVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 29 - protein, 493 aa, Artificial Sequence
  Recombinant HMPV F protein
KESYLEESCSTITEGYLSVLRTGWYTNVFTLEVGDVENLTCADCPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEGGYIPEAPRDGQAYVRKDGEWVLLSTF

SEQ ID NO: 30 - protein, 493 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 31 - protein, 493 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 32 - protein, 493 aa, Artificial Sequence
  Recombinant HMPV F protein
KESYLEESCSTITEGYLSVLRTGWYTNVFTLEVGDVENLTCADCPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEGGYIPEAPRDGQAYVRKDGEWVLLSTF

SEQ ID NO: 33 - protein, 493 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 34 - protein, 493 aa, Artificial Sequence; identical to SEQ ID NO: 29
  Recombinant HMPV F protein

SEQ ID NO: 35 - protein, 493 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 36 - protein, 493 aa, Artificial Sequence
  Recombinant HMPV F protein
KESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLCMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEGGYIPEAPRDGQAYVRKDGEWVLLSTF

SEQ ID NO: 37 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 38 - protein, 493 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 39 - protein, 493 aa, Artificial Sequence
  Recombinant HMPV F protein
KESYLEESCSTITEGYLSVLRTGWYTNVFTLEVGDVENLTCADGPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLCMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEGGYIPEAPRDGQAYVRKDGEWVLLSTF

SEQ ID NO: 40 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 41 - protein, 493 aa, Artificial Sequence; identical to SEQ ID NO: 36
  Recombinant HMPV F protein

SEQ ID NO: 42 - protein, 493 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 43 - protein, 493 aa, Artificial Sequence
  Recombinant HMPV F protein
KESYLEESCSTITEGYLSVLRTGWYTNVFTLEVGDVENLTCADCPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLCMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEGGYIPEAPRDGQAYVRKDGEWVLLSTF

SEQ ID NO: 44 - protein, 493 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 45 - protein, 493 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEGGYIPEAPRDGQAYVRKDGEWVLLSTF

SEQ ID NO: 46 - protein, 493 aa, Artificial Sequence
  Recombinant HMPV F protein
KESYLEESCSTITEGYLSVLRTGWYTNVFTLEVGDVENLTCADCPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLCMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEGGYIPEAPRDGQAYVRKDGEWVLLSTF

SEQ ID NO: 47 - protein, 493 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 48 - protein, 493 aa, Artificial Sequence; identical to SEQ ID NO: 43
  Recombinant HMPV F protein

SEQ ID NO: 49 - protein, 493 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEGGYIPEAPRDGQAYVRKDGEWVLLSTF

SEQ ID NO: 50 - protein, 520 aa, Artificial Sequence
  Recombinant HMPV F protein
KESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 51 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 52 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 53 - protein, 520 aa, Artificial Sequence
  Recombinant HMPV F protein
KESYLEESCSTITEGYLSVLRTGWYTNVFTLEVGDVENLTCADGPSLIKTELDLTKSALRELKPVSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 54 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGCLKQTNECVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 55 - protein, 520 aa, Artificial Sequence; identical to SEQ ID NO: 50
  Recombinant HMPV F protein

SEQ ID NO: 56 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGCLKTTNECVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 57 - protein, 520 aa, Artificial Sequence
  Recombinant HMPV F protein
KESYLEESCSTITEGYLSVLRTGWYTNVFTLEVGDVENLTCADGPSLIKTELDLTKSALRELRTCSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 58 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 59 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 60 - protein, 520 aa, Artificial Sequence
  Recombinant HMPV F protein
KESYLEESCSTITEGYLSVLRTGWYTNVFTLEVGDVENLTCADGPSLIKTELDLTKSALRELKPCSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 61 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 62 - protein, 520 aa, Artificial Sequence; identical to SEQ ID NO: 57
  Recombinant HMPV F protein

SEQ ID NO: 63 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 64 - protein, 520 aa, Artificial Sequence
  Recombinant HMPV F protein
KESYLEESCSTITEGYLSVLRTGWYTNVFTLEVGDVENLTCADGPSLIKTELDLTKSALRELRTCSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 65 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 66 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTCSADQLAREEQIENPRQSRFVLGAIALGVATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 67 - protein, 520 aa, Artificial Sequence
  Recombinant HMPV F protein
KESYLEESCSTITEGYLSVLRTGWYTNVFTLEVGDVENLTCADGPSLIKTELDLTKSALRELKPCSADQLAREEQIENPRQSRFVLGAIALGVATAAAVTAGVAIAKTIRLESEVTAIKNCLKKTNECVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 68 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGCLKQTNECVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 69 - protein, 520 aa, Artificial Sequence; identical to SEQ ID NO: 64
  Recombinant HMPV F protein

SEQ ID NO: 70 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIENPRQSRFVLGAIALGVATAAAVTAGIAIAKTIRLESEVNAIKGCLKTTNECVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 71 - protein, 520 aa, Artificial Sequence
  Recombinant HMPV F protein
KESYLEESCSTITEGYLSVLRTGWYTNVFTLEVGDVENLTCADCPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 72 - protein, 520 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 73 - protein, 520 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 74 - protein, 520 aa, Artificial Sequence
  Recombinant HMPV F protein
KESYLEESCSTITEGYLSVLRTGWYTNVFTLEVGDVENLTCADCPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 75 - protein, 520 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 76 - protein, 520 aa, Artificial Sequence; identical to SEQ ID NO: 71
  Recombinant HMPV F protein

SEQ ID NO: 77 - protein, 520 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 78 - protein, 520 aa, Artificial Sequence
  Recombinant HMPV F protein
KESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLCMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 79 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 80 - protein, 520 aa, Artificial Sequence
  Recombinant HMPV F protein
KESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 81 - protein, 520 aa, Artificial Sequence
  Recombinant HMPV F protein
KESYLEESCSTITEGYLSVLRTGWYTNVFTLEVGDVENLTCADGPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLCMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 82 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 83 - protein, 520 aa, Artificial Sequence; identical to SEQ ID NO: 78
  Recombinant HMPV F protein

SEQ ID NO: 84 - protein, 520 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 85 - protein, 520 aa, Artificial Sequence
  Recombinant HMPV F protein
KESYLEESCSTITEGYLSVLRTGWYTNVFTLEVGDVENLTCADCPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLCMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 86 - protein, 520 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 87 - protein, 520 aa, Artificial Sequence
  Recombinant HMPV F protein
KESYLEESCSTITEGYLSVLRTGWYTNVFTLEVGDVENLTCSDCPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 88 - protein, 520 aa, Artificial Sequence
  Recombinant HMPV F protein
KESYLEESCSTITEGYLSVLRTGWYTNVFTLEVGDVENLTCADCPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLCMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 89 - protein, 520 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 90 - protein, 520 aa, Artificial Sequence; identical to SEQ ID NO: 85
  Recombinant HMPV F protein

SEQ ID NO: 91 - protein, 520 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 92 - protein, 35 aa, Artificial Sequence
  GCN4 trimerization domain
KLMKQIEDKIEEILSKIYHIENEIARIKKLIGEAP

SEQ ID NO: 93 - protein, 124 aa, Artificial Sequence
  MPE8 anitbody VH
EVQLVESGGGLVKPGGSLRLSCAASGFTFSSYSMNWVRQAPGKGLEWVSSISASSSYSDYADSAKGRFTISRDNAKTSLFLQMNSLRAEDTAIYFCARARATGYSSITPYFDIWGQGTLVTVSS

SEQ ID NO: 94 - protein, 110 aa, Artificial Sequence
  MPE8 anitbody VL
QSVVTQPPSVSGAPGQRVTISCTGSSSNIGAGYDVHWYQQLPGTAPKLLIYDNNNRPSGVPDRFSASKSGTSASLAITGLQAEDEADYYCQSYDRSLSGVFGTGTKVTVL

SEQ ID NO: 95 - protein, 6 aa, Artificial Sequence
  Peptide linker
GSGSGS

SEQ ID NO: 96 - protein, 26 aa, Artificial Sequence
  T4 fibritin trimerization domain
GYIPEAPRDGQAYVRKDGEWVLLSTF

SEQ ID NO: 97 - protein, 4 aa, Artificial Sequence
  Protease cleavage site
RQSR

SEQ ID NO: 98 - protein, 4 aa, Artificial Sequence
  Protease cleavage site
RQSR

SEQ ID NO: 99 - protein, 6 aa, Artificial Sequence
  Protease cleavage site
RRRRRR

SEQ ID NO: 100 - protein, 4 aa, Artificial Sequence
  Protease cleavage site
RRRR

SEQ ID NO: 101 - protein, 4 aa, Artificial Sequence
  Protease cleavage site
RAKR

SEQ ID NO: 102 - protein, 4 aa, Artificial Sequence
  Protease cleavage site
RKAR

SEQ ID NO: 103 - protein, 173 aa, Artificial Sequence
  ferritin subunit
ESQVRQQFSKDIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 104 - protein, 154 aa, Artificial Sequence
  Lumazine synthase subunit
MQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 105 - protein, 265 aa, Artificial Sequence [sequence omitted]

SEQ ID NO: 106 - protein, 265 aa, Artificial Sequence [sequence omitted]

SEQ ID NO: 107 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNCVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNCVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 108 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNCGRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNCVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 109 - protein, 497 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNCGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNCVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 110 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPECQFNCALDQVFESIENSQALVDQSNKILNSAESAIGGYIPEAPRDGQAYVRKDGEWVLLSTF

SEQ ID NO: 111 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGACKTTNEAVSTLGNGVRVLATCVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 112 - protein, 496 aa, Artificial Sequence
  Recombinant HMPV F protein
KESYLECSCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKCRPVSSSFDPIKFPEDQFNVALDQVFESIENSQALVDQSNKILNSAESAIGGYIPEAPRDGQAYVRKDGEWVLLSTF

SEQ ID NO: 113 - protein, 496 aa, Artificial Sequence
  Recombinant HMPV F protein
KESYLEESCSTITEGYLSVLRTGWYCNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNGCRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 114 - protein, 496 aa, Artificial Sequence
  Recombinant HMPV F protein
KESYLEESCSTITEGYLSVLRTGWYTNVFTLCVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNGVRVLATAVRELCEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 115 - protein, 496 aa, Artificial Sequence
  Recombinant HMPV F protein
KESYLEESCSTITEGYLSVLRTGWYTNVFTLEVGDVENLTCTDGPSLIKTELDLTKSALRCLKTCSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTCAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 116 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSCDQLAREEQIEGGGGGGFVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNACITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 117 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGCVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTCRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 118 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLCAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYCNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 119 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSCGRHPISMVALSPLGALVACYKGVSCSIGSNRVGIIKQLPKGCSYITNQDADTVTIDNTVYQLSKVEGEQHVIKGRPVSSSFDPIKFPEDCFNVALDQVFESIENSQALVDQSNKILNSAESAIGGYIPEAPRDGQAYVRKDGEWVLLSTF

SEQ ID NO: 120 - protein, 496 aa, Artificial Sequence
  Recombinant HMPV F protein
KESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCCEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVCSSFDPIKFPEDQFNVALDQVFESIENSQALVDQSNKILNSAESAIGGYIPEAPRDGQAYVRKDGEWVLLSTF

SEQ ID NO: 121 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTCGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYCLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 122 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVCAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYCLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 123 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNCVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNCVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 124 - protein, 479 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNCGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNCVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 125 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPECQFNCALDQVFESIENSQALVDQSNKILNSAESAIGGYIPEAPRDGQAYVRKDGEWVLLSTF

SEQ ID NO: 126 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGACKTTNEAVSTLGNGVRVLATCVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 127 - protein, 478 aa, Artificial Sequence
  Recombinant HMPV F protein
KESYLECSCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKCRPVSSSFDPIKFPEDQFNVALDQVFESIENSQALVDQSNKILNSAESAIGGYIPEAPRDGQAYVRKDGEWVLLSTF

SEQ ID NO: 128 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSCGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVACSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 129 - protein, 479 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGCGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVACSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 130 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSCGRHPISMVALSPLGALVACYKGVSCSIGSNRVGIIKQLPKGCSYITNQDADTVTIDNTVYQLSKVEGEQHVIKGRPVSSSFDPIKFPEDCFNVALDQVFESIENSQALVDQSNKILNSAESAIGGYIPEAPRDGQAYVRKDGEWVLLSTF

SEQ ID NO: 131 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCCEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVCSSFDPIKFPEDQFNVALDQVFESIENSQALVDQSNKILNSAESAIGGYIPEAPRDGQAYVRKDGEWVLLSTF

SEQ ID NO: 132 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSACQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETCGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 133 - protein, 479 aa, Artificial Sequence
  Recombinant HMPV F protein
KESYLEESCSTITEGYLSVLRTGWYTNVFTLEVGDVENLTCTDGPSLIKTELDLTKSALRELKTCSADCQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETCGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 134 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDEDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 135 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDFDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 136 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDQDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 137 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAISFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 138 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAISFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDEDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 139 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKPTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 140 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 141 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTPECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 142 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 143 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 144 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVPLDQVFESIENSQALVDQSNKILNSAESAIGGYIPEAPRDGQAYVRKDGEWVLLSTF

SEQ ID NO: 145 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKKTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVPLDQVFESIENSQALVDQSNKILNSAESAIGGYIPEAPRDGQAYVRKDGEWVLLSTF

SEQ ID NO: 146 - protein, 6 aa, Artificial Sequence
  Peptide linker
GSGGSG

SEQ ID NO: 147 - protein, 6 aa, Artificial Sequence
  Peptide linker
GGGGGG

SEQ ID NO: 148 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKKTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPECQFNCPLDQVFESIENSQALVDQSNKILNSAESAIGGYIPEAPRDGQAYVRKDGEWVLLSTF

SEQ ID NO: 149 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKKTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSCGRHPISMVALSPLGALVACYKGVSCSIGSNRVGIIKQLPKGCSYITNQDADTVTIDNTVYQLSKVEGEQHVIKGRPVSSSFDPIKFPEDCFNVPLDQVFESIENSQALVDQSNKILNSAESAIGGYIPEAPRDGQAYVRKDGEWVLLSTF

SEQ ID NO: 150 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKKTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPECQFNCPLDQVFESIENSQALVDQSNKILNSAESAIGGYIPEAPRDGQAYVRKDGEWVLLSTF

SEQ ID NO: 151 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKKTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSCGRHPISMVALSPLGALVACYKGVSCSIGSNRVGIIKQLPKGCSYITNQDADTVTIDNTVYQLSKVEGEQHVIKGRPVSSSFDPIKFPEDCFNVPLDQVFESIENSQALVDQSNKILNSAESAIGGYIPEAPRDGQAYVRKDGEWVLLSTF

SEQ ID NO: 152 - protein, 478 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLESEVTAIKNCLKKTNECVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAESAIGGYIPEAPRDGQAYVRKDGEWVLLSTF

SEQ ID NO: 153 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAESAIGGYIPEAPRDGQAYVRKDGEWVLLSTF

SEQ ID NO: 154 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAESAIGGYIPEAPRDGQAYVRKDGEWVLLSTF

SEQ ID NO: 155 - protein, 478 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLESEVTAIKNCLKKTNECVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAESAIGGYIPEAPRDGQAYVRKDGEWVLLSTF

SEQ ID NO: 156 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKQTNECVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 157 - protein, 478 aa, Artificial Sequence; identical to SEQ ID NO: 152
  Recombinant HMPV F protein

SEQ ID NO: 158 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTF

SEQ ID NO: 159 - protein, 478 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLPSEVTAIKNCLKKTNECVSTLGNGVRVLATAVPELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVPLDQVFESIENSQALVDQSNRILSSAESAIGGYIPEAPRDGQAYVRKDGEWVLLSTF

SEQ ID NO: 160 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVPLDQVFENIENSQALVDQSNRILSSAESAIGGYIPEAPRDGQAYVRKDGEWVLLSTF

SEQ ID NO: 161 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVPLDQVFENIENSQALVDQSNRILSSAESAIGGYIPEAPRDGQAYVRKDGEWVLLSTF

SEQ ID NO: 162 - protein, 478 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLPSEVTAIKNCLKKTNECVSTLGNGVRVLATAVPELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVPLDQVFENIENSQALVDQSNRILSSAESAIGGYIPEAPRDGQAYVRKDGEWVLLSTF

SEQ ID NO: 163 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKQTNECVSTLGNGVRVLATAVPELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVPLDQVFESIENSQALVDQSNKILNSAESAIGGYIPEAPRDGQAYVRKDGEWVLLSTF

SEQ ID NO: 164 - protein, 478 aa, Artificial Sequence; identical to SEQ ID NO: 159
  Recombinant HMPV F protein

SEQ ID NO: 165 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVPLDQVFESIENSQALVDQSNKILNSAESAIGGYIPEAPRDGQAYVRKDGEWVLLSTF

SEQ ID NO: 166 - protein, 478 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLPSEVTAIKNCLKKTNECVSTLGNGVRVLATAVPELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPVKFPEDCFNVPLDQVFESIENSQALVDQSNRILSSAESAIGGYIPEAPRDGQAYVRKDGEWVLLSTF

SEQ ID NO: 167 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPIKFPEDCFNVPLDQVFENIENSQALVDQSNRILSSAESAIGGYIPEAPRDGQAYVRKDGEWVLLSTF

SEQ ID NO: 168 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPIKFPEDCFNVPLDQVFENIENSQALVDQSNRILSSAESAIGGYIPEAPRDGQAYVRKDGEWVLLSTF

SEQ ID NO: 169 - protein, 478 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLPSEVTAIKNCLKKTNECVSTLGNGVRVLATAVPELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPVKFPEDCFNVPLDQVFENIENSQALVDQSNRILSSAESAIGGYIPEAPRDGQAYVRKDGEWVLLSTF

SEQ ID NO: 170 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKQTNECVSTLGNGVRVLATAVPELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSCGRHPISMVALSPLGALVACYKGVSCSIGSNWVGIIKQLPKGCSYITNQDADTVTIDNTVYQLSKVEGEQHVIKGRPVSSSFDPIKFPEDCFNVPLDQVFESIENSQALVDQSNKILNSAESAIGGYIPEAPRDGQAYVRKDGEWVLLSTF

SEQ ID NO: 171 - protein, 478 aa, Artificial Sequence; identical to SEQ ID NO: 166
  Recombinant HMPV F protein

SEQ ID NO: 172 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSCGRHPISMVALSPLGALVACYKGVSCSIGSNRVGIIKQLPKGCSYITNQDADTVTIDNTVYQLSKVEGEQHVIKGRPVSSSFDPIKFPEDCFNVPLDQVFESIENSQALVDQSNKILNSAESAIGGYIPEAPRDGQAYVRKDGEWVLLSTF

SEQ ID NO: 173 - protein, 478 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLPSEVTAIKNCLKKTNECVSTLGNGVRVLATAVPELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPECQFNCPLDQVFESIENSQALVDQSNRILSSAESAIGGYIPEAPRDGQAYVRKDGEWVLLSTF

SEQ ID NO: 174 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPECQFNCPLDQVFENIENSQALVDQSNRILSSAESAIGGYIPEAPRDGQAYVRKDGEWVLLSTF

SEQ ID NO: 175 - protein, 478 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPECQFNCPLDQVFENIENSQALVDQSNRILSSAESAIGGYIPEAPRDGQAYVRKDGEWVLLSTF

SEQ ID NO: 176 - protein, 478 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLPSEVTAIKNCLKKTNECVSTLGNGVRVLATAVPELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPECQFNCPLDQVFENIENSQALVDQSNRILSSAESAIGGYIPEAPRDGQAYVRKDGEWVLLSTF

SEQ ID NO: 177 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKQTNECVSTLGNGVRVLATAVPELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPECQFNCPLDQVFESIENSQALVDQSNKILNSAESAIGGYIPEAPRDGQAYVRKDGEWVLLSTF

SEQ ID NO: 178 - protein, 478 aa, Artificial Sequence; identical to SEQ ID NO: 173
  Recombinant HMPV F protein

SEQ ID NO: 179 - protein, 478 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPECQFNCPLDQVFESIENSQALVDQSNKILNSAESAIGGYIPEAPRDGQAYVRKDGEWVLLSTF

SEQ ID NO: 180 - protein, 502 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLESEVTAIKNCLKKTNECVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 181 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 182 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLESEVTAIKNCLKTTNECVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 183 - protein, 502 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLESEVTAIKNCLKKTNECVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 184 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKQTNECVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 185 - protein, 502 aa, Artificial Sequence; identical to SEQ ID NO: 180
  Recombinant HMPV F protein

SEQ ID NO: 186 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLESEVNAIKGCLKTTNECVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 187 - protein, 502 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLPSEVTAIKNCLKKTNECVSTLGNGVRVLATAVPELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVPLDQVFESIENSQALVDQSNRILSSAEKGNTGFIIVIILIAVLGSTMILVSVFIIIKKTKKPTGAPPELSGVTNNGFIPHN

SEQ ID NO: 188 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVPLDQVFENIENSQALVDQSNRILSSAEKGNTGFIIVIILIAVLGSSMILVSIFIIIKKTKKPTGAPPELSGVTNNGFIPHS

SEQ ID NO: 189 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVPLDQVFENIENSQALVDQSNRILSSAEKGNTGFIIVIILIAVLGSSMILVSIFIIIKKTKKPTGAPPELSGVTNNGFIPHS

SEQ ID NO: 190 - protein, 502 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLPSEVTAIKNCLKKTNECVSTLGNGVRVLATAVPELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVPLDQVFENIENSQALVDQSNRILSSAEKGNTGFIIVIILIAVLGSSMILVSVFIIIKKTRKPTGAPPELSGVTNNGFIPHS

SEQ ID NO: 191 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKQTNECVSTLGNGVRVLATAVPELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVPLDQVFESIENSQALVDQSNKILNSAEKGNTGFIIVVILVAVLGLTMISVSIIIIIKKTRKPTGAPPELNGVTNGGFIPHS

SEQ ID NO: 192 - protein, 502 aa, Artificial Sequence; identical to SEQ ID NO: 187
  Recombinant HMPV F protein

SEQ ID NO: 193 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVPLDQVFESIENSQALVDQSNKILNSAEKGNTGFIIVIILIAVLGLTMISVSIIIIIKKTRKPTGAPPELNGVTNGGFIPHS

SEQ ID NO: 194 - protein, 502 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLPSEVTAIKNCLKKTNECVSTLGNGVRVLATAVPELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPVKFPEDCFNVPLDQVFESIENSQALVDQSNRILSSAEKGNTGFIIVIILIAVLGSTMILVSVFIIIKKTKKPTGAPPELSGVTNNGFIPHN

SEQ ID NO: 195 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPIKFPEDCFNVPLDQVFENIENSQALVDQSNRILSSAEKGNTGFIIVIILIAVLGSSMILVSIFIIIKKTKKPTGAPPELSGVTNNGFIPHS

SEQ ID NO: 196 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPIKFPEDCFNVPLDQVFENIENSQALVDQSNRILSSAEKGNTGFIIVIILIAVLGSSMILVSIFIIIKKTKKPTGAPPELSGVTNNGFIPHS

SEQ ID NO: 197 - protein, 502 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLPSEVTAIKNCLKKTNECVSTLGNGVRVLATAVPELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSCGRHPISMVALSPLGALVACYKGVSCSIGSNRVGIIKQLNKGCSYITNQDADTVTIDNTVYQLSKVEGEQHVIKGRPVSSSFDPVKFPEDCFNVPLDQVFENIENSQALVDQSNRILSSAEKGNTGFIIVIILIAVLGSSMILVSVFIIIKKTRKPTGAPPELSGVTNNGFIPHS

SEQ ID NO: 198 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKQTNECVSTLGNGVRVLATAVPELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSCGRHPISMVALSPLGALVACYKGVSCSIGSNWVGIIKQLPKGCSYITNQDADTVTIDNTVYQLSKVEGEQHVIKGRPVSSSFDPIKFPEDCFNVPLDQVFESIENSQALVDQSNKILNSAEKGNTGFIIVVILVAVLGLTMISVSIIIIIKKTRKPTGAPPELNGVTNGGFIPHS

SEQ ID NO: 199 - protein, 502 aa, Artificial Sequence; identical to SEQ ID NO: 194
  Recombinant HMPV F protein

SEQ ID NO: 200 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSCGRHPISMVALSPLGALVACYKGVSCSIGSNRVGIIKQLPKGCSYITNQDADTVTIDNTVYQLSKVEGEQHVIKGRPVSSSFDPIKFPEDCFNVPLDQVFESIENSQALVDQSNKILNSAEKGNTGFIIVIILIAVLGLTMISVSIIIIIKKTRKPTGAPPELNGVTNGGFIPHS

SEQ ID NO: 201 - protein, 502 aa, Artificial Sequence
  Recombinant HMPV F protein
KESYLEESCSTITEGYLSVLRTGWYTNVFTLEVGDVENLTCADGPSLIKTELDLTKSALRELRTCSADQGSGGSGATAAAVTAGVAIAKTIRLPSEVTAIKNCLKKTNECVSTLGNGVRVLATAVPELKDFVSKNLTRAINKNKCDIADLKMAVSFSQFNRRFLNVVRQFSDNAGITPAISLDLMTDAELARAVSNMPTSAGQIKLMLENRCMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPECQFNCPLDQVFESIENSQALVDQSNRILSSAEKGNTGFIIVIILIAVLGSTMILVSVFIIIKKTKKPTGAPPELSGVTNNGFIPHN

SEQ ID NO: 202 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPECQFNCPLDQVFENIENSQALVDQSNRILSSAEKGNTGFIIVIILIAVLGSSMILVSIFIIIKKTKKPTGAPPELSGVTNNGFIPHS

SEQ ID NO: 203 - protein, 502 aa, Artificial Sequence
  Recombinant HMPV F protein
KESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIDDLKMAVSFSQFNRRFLNVVRQFSDNAGITPAISLDLMTDAELARAVSNMPTSAGQIKLMLENRCMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPECQFNCPLDQVFENIENSQALVDQSNRILSSAEKGNTGFIIVIILIAVLGSSMILVSIFIIIKKTKKPTGAPPELSGVTNNGFIPHS

SEQ ID NO: 204 - protein, 502 aa, Artificial Sequence
  Recombinant HMPV F protein
KESYLEESCSTITEGYLSVLRTGWYTNVFTLEVGDVENLTCADGPSLIKTELDLTKSALRELKPCSADQGSGGSGATAAAVTAGVAIAKTIRLPSEVTAIKNCLKKTNECVSTLGNGVRVLATAVPELKDFVSKNLTRAINKNKCDIDDLKMAVSFSQFNRRFLNVVRQFSDNAGITPAISLDLMTDAELARAVSNMPTAAGQIKLMLENRCMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPECQFNCPLDQVFENIENSQALVDQSNRILSSAEKGNTGFIIVIILIAVLGSSMILVSVFIIIKKTRKPTGAPPELSGVTNNGFIPHS

SEQ ID NO: 205 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKQTNECVSTLGNGVRVLATAVPELKEFVSKNLTSAINRNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPECQFNCPLDQVFESIENSQALVDQSNKILNSAEKGNTGFIIVVILVAVLGLTMISVSIIIIIKKTRKPTGAPPELNGVTNGGFIPHS

SEQ ID NO: 206 - protein, 502 aa, Artificial Sequence; identical to SEQ ID NO: 201
  Recombinant HMPV F protein

SEQ ID NO: 207 - protein, 502 aa, Artificial Sequence
  Recombinant HMPV F protein
KESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIADLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPECQFNCPLDQVFESIENSQALVDQSNKILNSAEKGNTGFIIVIILIAVLGLTMISVSIIIIIKKTRKPTGAPPELNGVTNGGFIPHS

SEQ ID NO: 208 - protein, 14 aa, Artificial Sequence
  Recombinant HMPV F protein
VPTIVMVDAYKRYK

SEQ ID NO: 209 - protein, 514 aa, Artificial Sequence
  Recombinant HMPV F protein
MSWKVMIIISLLITPQHGLKESYLEESCSTITEGYLSVLRTGWYTNVFTLEVGDVENLTCTDGPSLIKTELDLTKSALRELKTCSADQGSGGSGATAAAVTAGIAIAKTIRLPSEVNAIKGCLKTTNECVSTLGNGVRVLATAVPELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPECQFNCPLDQVFESIENSQALVDQSNKILNSAESAIGGYIPEAPRDGQAYVRKDGEWVLLSTFLGGVPTIVMVDAYKRYK

SEQ ID NO: 210 - protein, 514 aa, Artificial Sequence
  Recombinant HMPV F protein
MSWKVVIIFSLLITPQHGLKESYLEESCSTITEGYLSVLRTGWYTNVFTLEVGDVENLTCSDGPSLIKTELDLTKSALRELKTCSADQGSGGSGATAAAVTAGVAIAKTIRLPSEVTAIKNCLKTTNECVSTLGNGVRVLATAVPELKDFVSKNLTRAINKNKCDIPDLKMAVSFSQFNRRFLNVVRQFSDNAGITPAISLDLMTDAELARAVSNMPTSAGQIKLMLENRCMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPECQFNCPLDQVFENIENSQALVDQSNRILSSAESAIGGYIPEAPRDGQAYVRKDGEWVLLSTFLGGVPTIVMVDAYKRYK

SEQ ID NO: 211 - protein, 462 aa, Artificial Sequence
  Recombinant HMPV F protein
KESYLEESCSTITEGYLSVLRTGWYTNVFCLEVGDVENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHCIKGRPVSSSFDPIKFPEDQFNVALDQVFESIENSQALVDQSNKILNSAE

SEQ ID NO: 212 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNEAVSCLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENCQALVDQSNKILNSAE

SEQ ID NO: 213 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALCTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQCNKILNSAE

SEQ ID NO: 214 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTCEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALCDQSNKILNSAE

SEQ ID NO: 215 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNECVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQACVDQSNKILNSAE

SEQ ID NO: 216 - protein, 462 aa, Artificial Sequence
  Recombinant HMPV F protein
KESYLEESCSTITEGYLSVLRTGWYTNVFTLEVGDCENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPCSSSFDPIKFPEDQFNVALDQVFESIENSQALVDQSNKILNSAE

SEQ ID NO: 217 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFCRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKCRPVSSSFDPIKFPEDQFNVALDQVFESIENSQALVDQSNKILNSAE

SEQ ID NO: 218 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNCGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTICNTVYQLSKVEGEQHVIKGRPVSSSFDPIKFPEDQFNVALDQVFESIENSQALVDQSNKILNSAE

SEQ ID NO: 219 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNACSTVYYPNDKDCETRGDHVFCDTAAGINVAEQSRECNINISTTNYPCKVSTGRHPISMVALSPLGALVACYKGCSCSIGSNRVGIIKQLPKGCSYITNQDADTVTIDNTVYQLSKVEGEQHVIKGRPVSSSFDPIKFPEDQFNVALDQVFESIENSQALVDQSNKILNSAE

SEQ ID NO: 220 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGICPAISLDLMTDAELARAVSYMPTSAGQIKLMLENRAMVRRKGFCILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAE

SEQ ID NO: 221 - protein, 462 aa, Artificial Sequence
  Recombinant HMPV F protein
KESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNCGITPAISLDLMTDAELARAVSYMPTSAGQIKLMLENRAMVCRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAE

SEQ ID NO: 222 - protein, 466 aa, Artificial Sequence
  Recombinant HMPV F protein
KESYLEESCSTITEGYLSVLRTGWYTNVFCLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHCIKGRPVSSSFDPIKFPEDQFNVALDQVFESIENSQALVDQSNKILNSAE

SEQ ID NO: 223 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSCLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENCQALVDQSNKILNSAE

SEQ ID NO: 224 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLCTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQCNKILNSAE

SEQ ID NO: 225 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTCECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQACVDQSNKILNSAE

SEQ ID NO: 226 - protein, 466 aa, Artificial Sequence
  Recombinant HMPV F protein
KESYLEESCSTITEGYLSVLRTGWYTNVFTLEVGDCENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPCSSSFDPIKFPEDQFNVALDQVFESIENSQALVDQSNKILNSAE

SEQ ID NO: 227 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIADLCMAVSFSQFCRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKCRPVSSSFDPIKFPEDQFNVALDQVFESIENSQALVDQSNKILNSAE

SEQ ID NO: 228 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNCGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTICNTVYQLSKVEGEQHVIKGRPVSSSFDPIKFPEDQFNVALDQVFESIENSQALVDQSNKILNSAE

SEQ ID NO: 229 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIADLCMAVSFSQFNRRFLNVVRQFSDNAGICPAISLDLMTDAELARAVSYMPTSAGQIKLMLENRAMVRRKGFCILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAE

SEQ ID NO: 230 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIADLCMAVSFSQFNRRFLNVVRQFSDNCGITPAISLDLMTDAELARAVSYMPTSAGQIKLMLENRAMVCRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAE

SEQ ID NO: 231 - protein, 418 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 232 - protein, 430 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 233 - protein, 442 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 234 - protein, 454 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 235 - protein, 466 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 236 - protein, 478 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 237 - protein, 424 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 238 - protein, 436 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 239 - protein, 448 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 240 - protein, 460 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGGCLKTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 241 - protein, 472 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGTIRLESEVNAIKGCLKTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 242 - protein, 484 aa, Artificial Sequence
  Recombinant HMPV F protein
KESYLEESCSTITEGYLSVLRTGWYTNVFTLEVGDVENLTCTDCPSLIKTELDLTKSALRELKTVSADQLAREEQIEGGGGGGAAAVTAGIAIAKTIRLESEVNAIKGCLKTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTF

SEQ ID NO: 243 - protein, 24 aa, Artificial Sequence
  Recombinant HMPV F protein
LAREEQIENPRQSRFVLGAIALGV

SEQ ID NO: 244 - protein, 543 aa, Artificial Sequence
  Recombinant HMPV F protein
MATMSWKVMIIISLLITPQHGLKESYLEESCSTITEGYLSVLRTGWYTNVFTLEVGDVENLTCTDGPSLIKTELDLTKSALRELKTVSADQLAREEQIENPRKARFVLGAIALGVCTAAAVTAGIAIAKTIRLESEVNAIKGALKTTNEAVSTLGNGVRVLAFAVRELKEFVSKNLTSALNKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTACGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTFLGGLVPRGSHHHHHHSAWSHPQFEK

SEQ ID NO: 245 - protein, 543 aa, Artificial Sequence
  Recombinant HMPV F protein
MATMSWKVMIIISLLITPQHGLKESYLEESCSTITEGYLSVLRTGWYTNVFTLEVGDVENLTCTDGPSLIKTELDLTKSALRELKTVSADQLAREEQIENPRKARFVLGAIALGVCTAAAVTCGIAIAKTIRLESEVNAIKGALKTTNEAVSTLGNGVRVLAFAVRELKEFVSKNLTSALNKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTACGINVAEQSRECNINISTTNYPCKVSTGRHPISMVALSPLGALVACYKGVSCSIGSNRVGIIKQLPKGCSYITNQDADTVTIDNTVYCLSKVEGEQHVIKGRPVSSSFDPIKFPEDQFNVALDQVFESIENSQALVDQSNKILNSAESAIGGYIPEAPRDGQAYVRKDGEWVLLSTFLGGLVPRGSHHHHHHSAWSHPQFEK

SEQ ID NO: 246 - protein, 540 aa, Artificial Sequence
  Recombinant HMPV F protein
MSWKVMIIISLLITPQHGLKESYLEESCSTITEGYLSVLRTGWYTNVFTLEVGDVENLTCTDGPSLIKTELDLTKSALRELKTCSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIPDLKMAVSFSQFNRRFLNVVRQFSDNAGITPAISLDLMTDAELARAVSYMPTSAGQIKLMLENRCMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGYIPEAPRDGQAYVRKDGEWVLLSTFLGGLVPRGSHHHHHHSAWSHPQFEK

SEQ ID NO: 247 - protein, 539 aa, Artificial Sequence
  Recombinant HMPV F protein
MSWKVVIIFSLLITPQHGLKESYLEESCSTITEGYLSVLRTGWYTNVFTLEVGDVENLTCSDCPSLIKTELDLTKSALRELKTVSADQLAREEQIEGGGGGGFVLAIALGVATAAAVTAGVAIAKTIRLESEVTAIKNCLKTTNECVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPICFPEDQFNVALDQVFENIENCQALVDQSNRILSSAESAIGGYIPEAPRDGQAYVRKDGEWVLLSTFLGGLVPRGSHHHHHHSAWSHPQFEK

SEQ ID NO: 248 - protein, 540 aa, Artificial Sequence
  Recombinant HMPV F protein
MSWKVMIIISLLITPQHGLKESYLEESCSTITEGYLSVLRTGWYTNVFTLEVGDVENLTCTDCPSLIKTELDLTKSALRELKTVSADQLAREEQIEGGGGGGFVLGAIALGVATAAAVTAGIAIAKTIRLESEVNAIKGCLKTTNECVSTLGNGVRVLATAVRELKEFVSKNLTSAINKNKCDIADLCMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPICFPEDQFNVALDQVFESIENCQALVDQSNKILNSAESAIGGYIPEAPRDGQAYVRKDGEWVLLSTFLGGLVPRGSHHHHHHSAWSHPQFEK

SEQ ID NO: 249 - protein, 539 aa, Artificial Sequence
  Recombinant HMPV F protein
MSWKVVIIFSLLITPQHGLKESYLEESCSTITEGYLSVLRTGWYTNVFTLEVGDVENLTCSDCPSLIKTELDLTKSALRELKTVSADQLAREEQIEGGGGGGFVLAIALGVATAAAVTAGVAIAKTIRLESEVTAIKNCLKTTNECVSTLGNGVRVLATAVRELKDFVSKNLTRAINKNKCDIDDLCMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAESAIGGYIPEAPRDGQAYVRKDGEWVLLSTFLGGLVPRGSHHHHHHSAWSHPQFEK

SEQ ID NO: 250 - protein, 508 aa, Artificial Sequence
  Recombinant HMPV F protein
MSWKVVIIFSLLITPQHGLKESYLEESCSTITEGYLSVLRTGWYTNVFTLEVGDVENLTCSDGPSLIKTELDLTKSALRELKTVSADQLAREEQIENRRRRRAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAESAIGGLVPRGSHHHHHHSAWSHPQFEK

SEQ ID NO: 251 - protein, 508 aa, Artificial Sequence
  Recombinant HMPV F protein
MSWKVMIIISLLITPQHGLKESYLEESCSTITEGYLSVLRTGWYTNVFTLEVGDVENLTCTDGPSLIKTELDLTKSALRELKTVSADQLAREEQIENRRRRRAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNDKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAESAIGGLVPRGSHHHHHHSAWSHPQFEK

---

We claim:

1. An immunogen, comprising:

a recombinant human metapneumovirus (HMPV) F ectodomain trimer stabilized in a prefusion conformation by one or more amino acid substitutions in protomers of the trimer, the amino acid substitutions comprising cysteine substitutions at HMPV F positions 84 and 249 that form a non-natural inter-protomer disulfide bond, and cysteine substitutions at HMPV F positions 140 and 147 that form a non-natural intra-protomer disulfide bond; and wherein the protomers of the recombinant HMPV F ectodomain trimer are single chain proteins comprising one or more amino acid substitutions to remove the $F_1/F_2$ protease cleavage site and wherein the $F_2$ polypeptide and $F_1$ ectodomain are linked by a heterologous peptide linker; and wherein the amino acid numbering is according to the reference HMPV F sequence set forth as SEQ ID NO: 7.

2. The immunogen of claim 1, wherein the cysteine substitutions at HMPV F positions 84 and 249 are V84C/A249C substitutions, and the cysteine substitutions at HMPV F positions 140 and 147 are A140C/A147C substitutions.

3. The immunogen of claim 1, wherein the one or more amino acid substitutions further comprise cysteine substitutions at one or more of HMPV F positions 154 and 396, 454 and 458, 141 and 161, 26 and 439, 45 and 157, 51 and 166, 80 and 224, 86 and 212, 103 and 366, 103 and 366, 106 and 321, 365 and 455, and 293 and 443 to introduce a non-native disulfide bond.

4. The immunogen of claim 3, wherein the substitutions are G154C and R396C substitutions, D454C and V458C substitutions, L141C and A161C substitutions, E26C and G439C substitutions, T45C and V157C substitutions, E51C and K166C substitutions, E80C and D224C substitutions, A86C and G212C substitutions, F103C and G366C substitutions, F103C and G366C substitutions, G106C and P321C substitutions, T365C and Q455C substitutions, and/or S293C and S443C substitutions.

5. The immunogen of claim 1, wherein the one or more amino acid substitutions further comprise proline substitutions at one or more of HMPV F positions 131, 143, 145, 163, and 459.

6. The immunogen of claim 5, comprising E131P, R163P, and A459P substitutions.

7. The immunogen of claim 1, wherein the heterologous peptide linker joins HMPV F positions 88 and 113, 96 and 103, 97 and 103, 98 and 103, 100 and 103, or 101 and 103.

8. The immunogen of claim 1, wherein the F1/F2 protease cleavage site is mutated by substitution of residues 89-112 for a six amino acid glycine-serine linker.

9. The immunogen of claim 1, wherein the F1/F2 protease cleavage site is mutated by substitution of HMPV F positions 99-102 to GGGG, substitution of HMPV F positions 97-102 to GGGGGG (SEQ ID NO: 147), or substitution of HMPV F positions 89-112 to GSGGSG (SEQ ID NO: 146).

10. The immunogen of claim 1, wherein the one or more amino acid substitutions comprise:

V84C and A249C substitutions that form a non-natural disulfide bond, A140C and A147C substitutions that form a non-natural disulfide bond, and substitution of HMPV F positions 97-102 to GGGGGG (SEQ ID NO: 147);

V84C and A249C substitutions that form a non-natural disulfide bond, A140C and A147C substitutions that form a non-natural disulfide bond, and substitution of HMPV F positions 89-112 to GSGGSG (SEQ ID NO: 146);

V84C and A249C substitutions that form a non-natural disulfide bond, A140C and A147C substitutions that form a non-natural disulfide bond, T365C and Q455C that form a non-natural disulfide bond, and substitution of HMPV F positions 89-112 to GSGGSG (SEQ ID NO: 146);

V84C and A249C substitutions that form a non-natural disulfide bond, A140C and A147C substitutions that form a non-natural disulfide bond, D454C and V458C that form a non-natural disulfide bond, and substitution of HMPV F positions 89-112 to GSGGSG (SEQ ID NO: 146);

V84C and A249C substitutions that form a non-natural disulfide bond, A140C and A147C substitutions that form a non-natural disulfide bond, substitution of HMPV F positions 89-112 to GSGGSG (SEQ ID NO: 146), and E131P, R163P, and A459P substitutions;

V84C and A249C substitutions that form a non-natural disulfide bond, A140C and A147C substitutions that form a non-natural disulfide bond, T365C and Q455C that form a non-natural disulfide bond, and substitution of HMPV F positions 89-112 to GSGGSG (SEQ ID NO: 146), and E131P, R163P, and A459P substitutions; or V84C and A249C substitutions that form a non-natural disulfide bond, A140C and A147C substitutions that form a non-natural disulfide bond, D454C and V458C that form a non-natural disulfide bond, substitution of HMPV F positions 89-112 to GSGGSG (SEQ ID NO: 146), and E131P, R163P, and A459P substitutions.

11. The immunogen of claim 1, wherein the protomers of the recombinant HMPV F ectodomain trimer comprise the one or more amino acid substitutions and an amino acid sequence at least 90% identical to residues 1-466 of any one of SEQ ID NOs: 107-120, or residues 1-448 of any one of SEQ ID NOs: 121-123, 125-128, 130-132, 134-145, or 148-207, or residues 1-449 of any one of SEQ ID NOs: 124, 129, or 133.

12. The immunogen of claim 1, wherein the protomers of the recombinant HMPV F ectodomain trimer further comprise one or more additional amino acid substitutions compared to a native HMPV F sequence.

13. The immunogen of claim 1, wherein the protomers of the recombinant HMPV F ectodomain further comprise a mutation to enhance protease cleavage at a F1/F2 protease cleavage site.

14. The immunogen of claim 13, wherein the F1/F2 protease cleavage site is mutated by a RQSR99-102RRRR substitution, a RQSR99-102RKAR substitution, a RQSR99-102RAKR substitution, or a RQSR99-102RRRRRR (SEQ ID NO: 99) substitution.

15. The immunogen of claim 1, wherein a C-terminal residue of the protomers in the ectodomain is linked to a trimerization domain by a peptide linker, or is directly linked to the trimerization domain.

16. The immunogen of claim 15, wherein the trimerization domain is a T4 fibritin trimerization domain.

17. The immunogen of claim 16, wherein the protomers linked to the T4 fibritin trimerization domain comprise an amino acid sequence at least 90% identical to any one of SEQ ID NOs: 107-145, and 148-179 and comprise the one or more amino acid substitutions that stabilize the F ectodomain trimer in the prefusion conformation.

18. The immunogen of claim 1, wherein a C-terminal residue of the protomers in the ectodomain or a trimerization domain linked to the protomers in the ectodomain is linked to a moiety of an isopeptide bond conjugation system.

19. The immunogen of claim 1, wherein the recombinant HMPV F ectodomain trimer is soluble.

20. The immunogen of claim 1, wherein a C-terminal residue of the protomers of the recombinant HMPV F ectodomain trimer is linked to a transmembrane domain by a peptide linker, or is directly linked to the transmembrane domain.

21. The immunogen of claim 20, wherein the protomers linked to the transmembrane domain comprise an amino acid sequence at least 90% identical to any one of SEQ ID NOs: 180-207 and comprise the one or more amino acid substitutions that stabilize the F ectodomain trimer in the prefusion conformation.

22. The immunogen of claim 1, wherein a C-terminal residue of the protomers of the recombinant HMPV F ectodomain trimer is linked to a self-assembling protein nanoparticle subunit by a linker or is directly linked to the protein nanoparticle subunit.

23. A self-assembling protein nanoparticle, comprising the immunogen of claim 22.

24. A virus-like particle comprising the immunogen of claim 1.

25. An isolated nucleic acid molecule encoding a protomer of the recombinant HMPV F ectodomain trimer of claim 1.

26. The nucleic acid molecule of claim 25, operably linked to a promoter.

27. The nucleic acid molecule of claim 25, wherein the nucleic acid molecule is an mRNA molecule.

28. A vector comprising the nucleic acid molecule of claim 25.

29. The vector of claim 28, wherein the vector is a viral vector.

30. An immunogenic composition, comprising the immunogen of claim 1, a protein nanoparticle or a virus-like particle comprising the immunogen, or a nucleic acid molecule, or a vector encoding the immunogen, and a pharmaceutically acceptable carrier.

31. A method of producing a recombinant HMPV F ectodomain trimer stabilized in a prefusion conformation, comprising:

expressing the nucleic acid molecule or vector of claim 25 in a host cell to produce the recombinant HMPV F ectodomain trimer; and purifying the recombinant HMPV F ectodomain trimer.

32. A method for generating an immune response to a HMPV F ectodomain in a subject, comprising administering to the subject an effective amount of the immunogen, protein nanoparticle, virus-like particle, nucleic acid molecule, vector, or immunogenic composition of claim 1 to generate the immune response.

33. The method of claim 32, wherein the immune response treats or inhibits infection with HMPV.

34. The immunogen of claim 1, wherein the protomers in the recombinant HMPV F ectodomain trimer comprise the amino acid sequence set forth as residues 1-466 of any one of SEQ ID NOs: 107-120, or residues 1-448 of any one of SEQ ID NOs: 121-123, 125-128, 130-132, 134-145, or 148-207, or residues 1-449 of any one of SEQ ID NOs: 124, 129, or 133.

35. The immunogen of claim 16, wherein the protomers linked to the T4 fibritin trimerization domain comprise an amino acid sequence set forth as any one of SEQ ID NOs: 107-145, and 148-179.

36. The immunogen of claim 20, wherein the protomers linked to the transmembrane domain comprise an amino acid sequence set forth as any one of SEQ ID NOs: 180-207.

* * * * *